United States Patent 12,144,834 (METHODS AND COMPOSITIONS FOR TREATING GASTROINTESTINAL AND INFLAMMATORY DISORDERS) - sequence listing, part 5

SEQ ID NO: 426 - DNA, 32765 bp, Eubacterium hallii
gattttttgcaagcagccagacctgttctatttgtggttacaagaatgttaaaacgaaaaatcttgcgttaagagagtgggattgtccgcagtgtggaacccatcacgacagagatgtaaatgcggcaattcagaattaaaacgacaagggtatggaaaagcattacttgattattcattggataaggcagcgaaacttggctgtggtgcagtctgctttgagggaaacattgatttttatggaaaaagtggattcagaccggcaagcaaatttaacatccgttatcatggactggaagaaggggaggatgcatctttctttttatataaagagctgattcctggctatctgaatagtattacagcgacaccagtaggatattttgtagatgaaaagaaagccgaagaatttgataagttgtttccttataaagagaagaaaaaactaccggggcaattattttagtgaagtggattgcgaatatctacttcacatgcagatatgagtgcagtaagttttttgcattcatattattttttaacatatggattctaataaaaaaggtaaatccaacgtatgctgcagcatttaaggaaaaatgaaaacataaggagcaaatatggaatcagatataattaaaatcagccatctgaataaaagatttggcgaagtaaaagcggtaaatgatttgagctttcatgtgaaaaaaggagaattgtttgcatttcttggagtaaacggtgcagggaaaagtacaaccatttctattctctgtggactgctgaaaaaagacagtggaattgttctggtaaacggaatagaaactgacaaagccggtgcacagacaaaaagaatgcttggtgttgtatttcaggatagcgtacttgataaaccgcttacagtgaaagagaacctaatgagcagagctgctttgtacggcattacaggaaaggtttttgataagagattaatggatctggtcgagattttggattttgacgggtttttaaacagacctgtaggtaagctgtcgggaggtcagagaagaaggattgatattgcccgtgcattattgcacagaccagaaattttgattcttgacgagcctaccaccgggcttgatccgcagacgaggcagttaatctggaatgttatcgagaagcttcagaaaactgaaaatatgacagtatttttaaccacccattatatggaggaggctgctaatgccggatatgttatgattcttgacaaaggaagtattgcagcggaaggtacaccgtttgaacttaaaaatgattatgtacaggatatcgtgtctgtttatggtgtttccgaagatgaaataaagttattgaacagagaatataaaaaaattcgtgacggatatcagataaaagtaagaaatacgaaggaagctacgaagcttattgtagagcatcaggatttattcacagattatgaagtagtaaaaggcggtatggatgatgtatttcttgcagtcacagggaaaagattggaggtgaacgctgatgagaacagtattggcattaatgaacaggaataggaaactgttttttaaagataaaggtatgttgtttacatcaatgatcacacctgtaattctaattgttctatatgctacgtttcttgcaaaggttttcagagattcttttacagctgcaattccggatatgatcacgatttcggataagctcattaatggaactgtagcagcacagctgacagcatcacttatggcagtgagctgtatcactgtaacattttgtgtgaatctgactatggtgcaggacaaggcaaatggaacaaggaaggattttaatgtttcaccggtcagcagtggggaaatctatttaggatatttcctctcaacagcagctaattctttgatggttaatggacttgcatttgtattatgcctgggatatttatttaaaatgggatggtatatgaatgcagcagacgtattatgggttttatttgatatgatattgctcgtcctgtttggaagtacgctttcaagtatcattagctttccgttgacaacacagggacagctttcggctgtaggtacaattgtcagtgcaggatatggttttatatgtggtgcttatatgccaatttcaaattttgggtcaggtcttcagaagatgctgtcttatcttccgagtacatatgccacttcattgattaaaaatcatatgcttcaaggagtattcagggagatggaaggaaaacattatccgggtgaaatgattgaagtgataagagaaactcttgattgtaatccggtatttcatggaaatgtggtaagtgtaaatcagatgattggtattatgatgggaagtatagctgtatttggaattatttattattttattacattgctgtcagaaggtgaaggcggacgataggaaatattatttttagtgggtaaaagtcgagtcttctagctgatgacacgataggtgtcactcatgtgacagagcgattcttactatttttctgcaggatatgatgttgcatggtggtgaacgtgtcaggatacagaatctgcagggcgtgattagttggtataacagtaaaagataatcggaggtaatggttaaactctcgttaacttgtgaatccacttgtaacttcggaatcttaaaaatatcggaatccccttaaatatctgatcagactgtaaacagataactactgtagcaattggccatctccaccaaaaagcagcagctaaagacagtggaagcacaatgccccatgtactaatcatatttacataaagcgagaactttgtatctcctgcgccacgaatgattcccgagccaacgggcatctggtatgccatgccaaccatgactactgccataatgatgataagctgctctgcaagctgagaagcggttggacttaaggtatattgtgctaaaagaaagtcttttgtaaagtaaagaatagcagcaagaattattccaacacctacatcaagtacagagagcgttcttgctgcggcttttacctcatctaaatctcccctgccaactgcttttcccatcatgacagaagaagcggaagacatagcaagcacaacaactttcatatattgataaaatgtacttgcaacagaatttgcagctatcgcatcggaacttaaatgcccgagaattgcggtctgcatcggtacggaaatcgcccacaacattccagatataaaaactggaacagcaaccttcacataatctgaacgtaataatctatcaatgtgaaatactgctctatctgaaaataacttcaactttttatctatttttgctacataaataagcacaataaggaactctaaacatctcgatagcatcgtgccaattgctgccccacgaatttccaactctggaaagccaaatcgtccgtagattaaaatatagttaatacttacattgactactaaagaaacacacgatattacaaacgcgatccgtaccgtttcaacactgcgaagtgcagaaagaagtacctgtgttacaagatacaaaagaaatgtatactttataatctgcaaataacttcctgcctcggataaaattgccacatcggacgtaaaaaagcctaacattgcttctggaaacagcgagcataaaataatcaaaaagattcccaagcctagtgcgatcttcaagaccattcccgtaatctgccggattggctccattcgtttttgtccccaatattgtgaggaaataacaaccagcccatcaccgatcacaaccgctgcctgttggataaggaaaaatatctgattcaccaaagctgcaccagaaagagcattctgactgtacgccccaagcatgatgttatctgccatattcacactgtaagaaataagattctgcaacgaaataataataagtaatggaaataatgccgcataaaaatttttatcgtgagaaaaaaatgtttttttcatttataataaaatagcctttctgtagattccgaaaaccattataccagtttataagaaaagggaaaagagaaatttgtgtcagccagaaacagtatgatacaagagttgaagtaatagcatactttgcataatcttttttgtgcaatatattcatttttttacataaaaagtatcgattatgatacaataatgacataaaataagatataatataaaatatatcataaaaaggagtgtaaaaaatgaaaaaaacatggaaaaaatgggttgcattaggaatgacttttagtatgatggtgggtattgctggttgtggtaacagtaaacatgctggttcagaaaatacaacggaagcagcgaaaaaacaggaagcagctgcgccaatcaaaatcgcaacaaaaccgatgacagaacagtttattttaggcgaaatgttaaaattagttattgaagatactacggattattctgtggaacttacaaaaggaatcggaggcggtacaaataatattatgccggctatggaatccggtgactttgatttatatccggaatatacttcgtctggatatatcatggtattaaaacatgattcaaatggcataagtgatgaagatatgtggaaacagcttcagaaagagtataaggataaatatgatatgtcctggattggtcagtatggttttaacaatacgtatgcgcttattataagagaagaagctgcgaaaaagtataacctgacaaaaacatctcaactggcagatgtttcagatgagctggtttttggtggtaattctgattatattgaaagaaaagatggattccatcttctttgtgatacctatggattaaaatttaaagatgtaaaagatattgatattggtcttaaatatgaagcattgaaaaagggagatattgatgtttcaaatggttttacaacagatgcacagttaagtaatgataatgttcgtgttctagaagatgacaagcatttgcaggtaaattatttttgttctaatgttgtaagaaatgatacattaaaatcacatcctggattagaagaagcgattatgaaattagataattcgattactgacaaagaaatggcttctctaaattacaaagtagaagtggaaggtaaagaagatgtacaggtagcgaaagattaccttacagaaaaaggaattattaaataataatctcagacagcgatagaagaataaaaggatcgacataatggaactattaaaagaaattttgcaaatttatatggaacgcagagaatggtttctggaattatttgggcaacatcttaaaattgcgggaattgctatagtactagctggtattatgggcttacttcttggcatatttattgcggagaaagaatttatggctccagttattttaacactggcaaatattttctatacgattccatctatctctttattaggaattttgataccttttaccggaatcggagataaaacagcgatcattgccttgaccctatatggattgatgccaatgattcgaaatacatacaccggtatttgtggagtcagtcaggaaattatacaggctgccagagggatggggagtactgatatccagattttgtggagaattaaacttcccttagcgctcggtgttattctggccggtgtccgaaacatggtggttatgacattgtcagtaacagcgattgcggcatttattggtgccggaggattaggcgttgccatttacagaggaattacaatctataatccagcgcttacttttgccggaagtgtattgatcgcccttcttgcactgattgcagatttattgcttggaatacttgaaaattatgtaaagaagagaggtgtgtcgcagtgatacgaatggaagatgtatcgtatagttacggaaaaaaagaagtactgcatcactttaatcttcatgtaaaagaaggagaatttcttacagtaatcggctgttccggctgtgggaagacaacgatgctaaagctgatcaatgcgcttcttcttccttctttgggaactgtttatgtgcaggggcatgatattaccaaaacagatcatatagctttgcgcagaagcattggttatgcgattcagaataagggactttttccacatatgacagtagaagataatatcgcttatgttttaactatcagtggacagaaaaataaaaagcaaaaccaaaagcgtgttttagaacttttaaatttggtaggacttgaagaatctcttttaaaacgccgtccatcggaactgtccggtggacagcagcagcgtgtaggtattgcaagagctttggctgcaaaacctaaaattatgctgatggatgaaccttttggagctttagatgaaattactcggaaaatgatgcagaaagaactgctggcacttcataaaaagttaggtttgactgtcgtttttattacgcatgatatcagagaggcaatgaagctgggtgatcgtgtgcttgtcatggatcagggaagagctgtacagttagatagaccggaagtgattctttcccatccggcaaatgcctttgtacaggaattgattagtgactagtgacattcttgctatctatagatgtagtcatttcatatctgatgatataacatttgttacttcttttttgtaccgcagaatagtaaaataaattcaagaatgccatggtattcttggatttattttatggatagatttacatcatgtataaattaattttagggagtaaatgaggtgaaatattatggaacatacgaaattaacggaattattacatcaggtggcttccggtgatatcagtgtagaaaaggctgcattagagttgaagacagagccgtttgaagatcttggttttgcaaaacttgatcatcacagaaagattcgtcagggagcggcagaggtaatttatggtgccggaaaaactccagaacagatattaaagattacagaagcttttcgaaaaaaaagcgatagtgccgtattgattacaagaatgagccaggaagcggcagatcttgtgagtgcaagtcttccgctgcattataatgcacttagtaaaactggtattgtaggagaacttccgaagaaagacggaaatggaaaaatagtcattgcaacgggtgggacaagcgatttgcctgtagcggaagaagctgctctaactgctgaaattcttgggaatgaagttgtaagaatttatgatgttggtgttgcaggtatccatcgtttgttagcatattccgaagatttaatgagtgcccaggttatcgttgttattgccggaatggaaggcgctcttgccagtgtggtaggtgggcttgctgattgtccggttatcgcggtaccgaccagtgttggatatggcgcttcttttggaggtttgtccgctcttttatcaatgcttaactcctgcgcaagcggagtcagtgttgtcaatattgataatggttttggtgctggttatatggcaagtatgattaatcatgtctctgtgaaaaatccagaaaacgtaagaatgcagccacatcatttacataaacattcataaaaaacaaagcttactataaaagatagaaatgtaaaggagagtagttaaaatatgaaaacattatatttggaatgtaatatgggagctgccggagatatgcttacggcagcacttacggaattaatgcctgatccggatgcttttgtgcagcaattgaatgatttacagatccctcaggtaaagattaagcgaacaacaatagcaaaatgcggtattatgggaacgcatatggaagtaaccgtaaatggagaagaagaaaaaagtgttgatgtgccattgcatatgcatgaacaccattatgaagatcatgatcatatacatgaacatcaccatgcgggacatgatcatgtgcatgaacatcaccatgaggagcatgaccatgtgcatgaacatcaccacgaggggcatgaccatgtacatgagcacacacatggacacagtcatcatcatacgagtatgaaagatattgagcatattatcgggcatctgaatgtaccagaaaaggtaaaagaggatgcgattgccgtatacaaattaattgcagatgcagagagccatgctcatggatgtccggtggaggaaatacattttcatgaagttggagccatggatgcagtagcagatattgtcggggtttgtcttgcagtttataaacttgctccggaacagatcatagcttctcctgttcatgttggttatggtcagattcactgtgcccatggtattcttccaatcccggcacctgcaacagcgcatattctgcagggaattccgatttatggtggaagaattgaaggagagctttgcacaccgaccggagcagctcttttaaaacattttgcgcaatcttttggtcagatgccaatgatgtctgtagaaaaaacaggttatggtatgggaatgaaagactttactgatgcaaactgccttcgtgcgattatcggagaaagtatagaagaacaagagtatacagggtgtcatggtgaaccacaggaaatggattccattatagaactttgctgtaatcttgatgatatgactccggaaaagattggatttgtcacagaacttttgatgaaagaaggagcttttgatgtctatacgacaaatattcagatgaagaaaaaccgtccggcaatcatgcttacttgtatgtgtgccaaagaagacagagagaagtttcttacgcttattttaaaacatacaactacactgggggttcgtgaatataactgtaaacgctatggactgaaaagaaaaatcaaagaaatagaaactatatatggaacggttcatgtcaaagctgcttccggatacggtattgtaaaggaaaaaccagaatatgaagatatggcaagaatcgcgaaagaaaagaacatttcattgtcagaagtagaaaaagaaatctacaaaaaattgagtgaaaataaagcaaggtaatacaaaatatataaatagtaagtttataaaaaagctatttttccatctttaaacagtaaatatattggttgaaatcatgtccaaaaagagataaagtatatttgtaatgatagaatatttcattttaaatttaaatttagaaagggattatgaacatggaaaaatcaaaagtatattttactgactttagggcaaagttaggagagggacttccaatgaagttaaaaagacttctgaaaaaggctggaatctccaaaattgacatggaaaataaatttgtagccattaaaatgcattttggagaacttggtaacataagttttttacgtcccaattatgccaaagcggttgctgatgtagtaaaagaattaggtggaaagccatttttaacagattgtaatacgttatatccgggaagccgtaagaacgcattagaacatttgcagtgcgcctgggagaatggctttacagcaatgacggttggatgccctattttaattgcagacggtttaaaaggaacagatgatattgaggtacctgttgagggcggcgaatacatagaaaaagcaaagattggacgagcaatcatggatgcagacatttttattagtttaagccactttaaaggtcatgaaacgactggatttggcggagcgattaaaaatatcggtatgggctgtggctctcgtgcaggaaaaaaggaacagcatacgaatggtcagccaacgattcatgaagaattatgtcgtggatgccgtcgctgtatgagagaatgtgcgaataatggtcttgcatttgatgaagagacaaagaagatgcatattgatggaacgaattgtgtaggatgtggaagatgcattggcgcatgtaactttgatgcgattgaatttgaaaattgggcggcaacaaaagatttaaattgcagaatggcagaatacacaaaagcagtaattaatggaagaccgaatttccatatttcacttgttgttgatgtatccccaaactgtgactgccatgtggaaaatgatgcaccaattcttccgaatatcggaatgttcgcatcttttgatccattagcattggatcaggcatgtgtagatgcctgcttaaagatgcagccgcttccaaacagtcagctttttgaaaatatgcacagggaaggtttctgtgatcatcatgatcattttgaaaatactacgcctgagtctgaatacaaaacctgtctggaacatgcagaaaagattcatctcggaaacagaaattatgagctaattgtaatgaagtagcatttttgtcttgcatttttgttaagataagcgtattataaatacaattgaacaaaaggggagcttgtattacaggctgagaggaaggtatgaccttcgacccattaacctgatttggataatgccaacgtagggaagcatatatatttttgtatatttttacgggaagttaccgaatcggttacttctcgtttttttatgttacaggaggtgaaggcatggtaaaaattaacggacaagactgtgataaggcagggatttcagttgcagagtatcttgcagcggagaattataatgtaaatcatattgttgtggagtacaatcttacgatcattccaaaagaacagtatggtcagaccattcttaaagatggagacgaagtcgaaatcgtcagttttatgggtggtggatgttaataatttttatgaattattaaaaaagagatgtaattatatagaatcaatttattaatataatataggttggtttagaataatcacaaaccagtttagaaagaagggtgttttattatgcagacagaagataagttaatcattggcggtcatgaatttgaatctcgttttattcttggttcaggaaagtattctatgaaactgattgaagcagcggtacgcgatgccggagcacagattattacgttagcagttcgaagagcgaatacaaaagaacatgaaaatattttagattatattccaaaggatgtgacactgttaccaaacacttccggagcgagaaatgcacaggaagcagtgcgaatcgcacgattagcaagagaacttggctgtggaaattttgtaaaagtagagattatgcgtgatagtaagtatcttcttccggataatcaggaaacgattaaggcgacagaactccttgcaaaagaaggatttgttgttatgccatatatgtatccggatttaaatgttgccagggatcttgtgaatgcaggagcagcctgcgttatgccgttagcatctccgattggttctaacaaaggattagctacgaaagagttcatccagattttaattgatgagattgatcttccgattatcgtagatgcaggaatcggtaagccttcacaggcatgtgaggcaatggagatgggtgcagcagcaattatggcaaatactgcgttggcaactgccggtgatcttccaatgatggctgcagcttttcgtcaggcaatcgaagcaggaagaaaggcatatttatccggtttgggacgtgtgcttacaagaggagcagctgcatcagacccactgacaggatttttacattaaaagcgttgctggaaaagaggtattataatggaaaaccagtttttaatcgattcagaatacttatcgaaagaagcgttagagaagaaacaccgcctggaaacagacccttcctcaagaaagaatcatatggaatatatggaaggaatggaacagatcaaatcagatgtcatggataaagtgatgagtcagatgcattcctatgattatgaaaagtatacagcaaaagatgtaaaagcagcgttagaacatgaaacttgttctattgaagattttaaggcattattatctccggctgccgcaccatttttagagcagatggcacagaaagcaaaaatagaaacaagcaaacattttggaaatacggtatatctttttacccctctttatatagcaaactattgcgaaaactattgcgtttattgtggttttaactgttataatcatattaaccgcatgcagcttaatatggagcagattgctcatgagatgaaagtaatcgctgattccggtatggaagagattttaatacttacaggagagagcagggcaaaaagtgatgtcaaatatattggagaagcatgtaagcttgccagcaagtattttcgtatggtcggtctcgaaatttatccggtaaatacagatgaatatcgttatctgcatgaatgtggtgcagattatgttacagtttttcaggaaacctatgattccgataaatacgagacgttacatttgatgggacataagagggtatggccatatcgttttgaagcacaggaaagagctcttatgggcggaatgcgaggtgctggattttcagctcttcttggcttatccgattttcgaaaagatgccctggcaagtgctctgcatgtttattatctacagagaaagtatccacaggcagaactctccctttcttgtccaagacttcgtccaattattaataatgacaagatcaatcctttagatgtaggagaaaaacaactttgtcaggttttatgcgcttatcgtattttccttccatttgtcggaattacggtttcttccagagaaagtgaaacatttcgaaatggtattgtaaagattgcggcaacaaaagtatccgccggggtttctacaggaatcggtgaccacgaaagtaaatataccggaaaggaggaggacggtgagcagggcgatgaacagtttgagattaatgatgaacgaagttttaagaaaatgtacgaggatatttcagaagaaggtctgcagccggtcttaaacgattacctttatgtctgatcttatatgtatcacaaacaggaaactttgtagcaataacttttcagaccagatagaaatgattgccagtgcgcatccaaaagctattgtattaagagagaaagatctttctgagaaagaatatgagcaattagccagacaggtaatgcaaatttgtcagaagcatggaacacagtgtattctccatagtttttctaatgtagcaattgcacttggggcagaggcagtgcatatgccattaccattacttcaaaaaatgacaccgcaagaaaaatcacattttcaaataattggagcttcttgtcattctttagaagaagcaaaagaagcacaggatttaggatgtacctatattactgccgggcacattttcctcactgactgtaaaaaaggattaccaggaaggggacttccttttttagaagagatctgcaaagcggttagaattccggtatatgcaattggaggaatctcttcacagaacattgagtccgtcaggaagacaggggcagcaggagcatgtatcatgagtggttttatgcggtgtaagactgtggaagaaatcatgtaaatgctattacttttaaaactttatatactcctaaggattaagaattgcatttttcgacagaaaatgttaagataaatgcggtaaaatattaatttttctattatttatgcaggtatacagcagataaattgcataatcagagcataatttttataatttataataaagagggcaattttgctaaccgatgcttatatgtatatgtttatatgtaaagatataaaacaatctgtaaataatatagtaaacagcaagataatagaaaaccattaggaggtaatatgagtagaatgacgaacaatatgtcagaagaactattcaaagtggatggaaagacatcagttggtgaaacccttccgcttgccctgcaacatgtggtggccatgattgtaggatgtgttacaccggcaatcattgtagctggtgtagctggattatccgaacaggattcggttatcttaattcaggcagcccttacaatgtcagcaatcacaacacttattcaagtagttccgctgcttagaacaggtaaagtttcgattggttccgggcttccggttattatgggtatcagttttgcctatgtgccaacaatgcaggcaattgcaggaacctttgatattgcaaccattttaggagcgcagattgtcggaggtattgtagcggttatcgttggtatttttatcaaacagattcgtaagttttttccaccattaattactggtacggttgtatttgctattggactttctttatatccgacagcaattaattacatggcaggtggagcaagtaatgaaagctatggctcctggcagaactggcttgtagcaattattacactctgtatcgtaacggtactcaatcattatggaaaaggaatctggaaactggcatccatattaattggaatcattgcaggatatatcatttcattattctttggaatggttgatttttctgccgtagtaaatgcatcctggtttgcgttaccaaaaccaatgcattttggtgttacgtttgaaccttcttcttgtgtagcaattggagtattatttgcgatcaactctattcaggcaattggagacttttctgcgacaacgacaggagggcttgaccgtatgcctacagatgaagaattaagcggtggtatcgtaggctatggtttaagcaatattttctgtgcagtatttggtggtcttccaacagctacatacagtcagaatgtaggtatcgtaggttccacaaaagttgttgcaaaaagagtatttgaaacttctgcaattattatccttattgcaggattaattccgaagttttcttcagtactgacaacaataccatactgtgtacttggtggagcaactgtttctgtatttgcatcaattgcaatgacaggaattaagctcattacaacggcaccgatggattttagaaatacaacggtagttggtttatccatcgcacttggaatgggtgtgacacaggctaatgcagcactggcaaccttcccggaatgggtaacaacaatctttggaaaatccccggtagtattagcaacaatcactgcagtatttttaaatctggtattaccaaagtcagaacaatcctgatttatagatttaatgtagacgaaaaaagaaaaaaataatacatcccatctgctctgtagtcgctgtatttaagatgctcgtccgcatcttaaacacgctccgaagccgcatctgggatgtattatttttttcttttttctggctatctaaatctacagtttggtgagaatggagtcctccagaaggttatgactttccgggaaattaaagcctaatggattgacgcattcttctgggaaaaccccttattttttcacccaaaatcctgattttatctggcgccaaagaacagaaaagcagaaactttatatagaataaaaatgtgatgtcggagcaagtaaaaatgccggtcaggcattttctatgccgcgactatcttcacattttattctatataaagtttctgcttttcgtttctttagttcatcaaatcaggatttaattatttatttctcctaagtatctgtaaattgttgcctgtgaacaggagaatctttttgcgacaaaaggtatggagccttttaattgaaataaaccctgttcatgaagctttatcataatctcttttcgctcattctgattcagacggtctactggtgttttaagattggcagttgcatcattgaaaatctgttctcttagagctgcaacgtctattgcaaagttttccgtaatactgctggataaatcttttatattatccgtactatttgaaagtccaaaagctatatttttaacaaaatttccaggatggatcatggaaaataatttctcgtgaagctccatatatcggctgtcatcgaagttaatacataaaagaccaatcggattcccgttggagtctttaatgaacatactagaagaacggagaatatgtccattttccgcaacacctttataattggcaataaaatcattctcctcatatactttggaggaaagcatctgaaatacagcacttgtaagaggactgccaatagtccttccgctgatatgaccattttcgattgcaattacagaatgattcttattggataggtcctgaagaacgacttcgtaatccgggcctaatacgctgcctaaaaactttacagtggttttataggaataaagtaaatctaacataacggttcctttcaccctaacatctttatagtggagttgataattatttaccaagcagaaaaattattattgtgataaaaatttctataaataaaataccataaaatgcgataaaaatacagtttttttgagaaaacaatggattgactttcctaattttccccgatatagttatgtaagaatggaaaaatggaggaagaatgatggcaaaaaagaaaatttacgccgtaagaaaaggaaataaaacaggattattttattcatgggatgaatgtaaaaaagcagtgcatggctattctggagcagaatataagggatttttaacgaaggaagaagcagaagattttttaaatattggagcagttaagacagctactggtaaaaatttttcaacagcagcaacaagtatagattctagtccattgacaacctcaacacctaaccggcttgttgtttatgtagacggaagttttgacgtaaatcttcaaaaatattcttttggctgtgttattttactggaagatggaagaatcctcgagcgatatggaaatggtgaggagccggaacttctggctattcgtaatgtagccggagagatgtatggagcaatgtatgcagtacagtgggcatttgaaaacggttattcttctgttgttcttcattatgattatgagggaattgaaaaatgggcaacgggtgtatggactgcgaagaatccacatacgaagaaatatgttgcatttatgagaaatatgcaggagaagatggaagttatattccagaaagtaagagcacactccggagattattataatgaacaggttgatcagcttgcaaagaaagctttaataaacgggaatggaataccagctatcgataaaataaaaaaataggagttacaaatcaaaaaacatacaaatatcatatttactaataatgtttccgaatatattatcgtgaatttatataaaactctattgtgtttttataggtattcatgttattatacataaaagagaaggtcttttataatttcacaaaagggaggaaacaaatatggtaaaacgaaaaacattagtaagtatattaataagcttattgctttgcgtaggattacttccactgaagactttagctgcacctgctgcacctgctggggaatggactgattatgtagcagactcttttgcaagcggtaaaggaacaaaagaagacccctatataattaattccccaaaacagctggctaaattagcaaaagatatcaattccggaattgcagatcaagaatatactcataataaagaatactttttattaggtaatgatattgatttatccgcacaccgttggattccaattggctctggaacttctacaagtacaagttcttttcattcttttaccggatattttgatggtgcgaataaaacaatttctggtttatatgtagacgaaagttctgaaagatttagtgcgggattattcggtcacgtttccggaattgaaatcaaaaatgttataattaaggatggttatgtaaaaacggaagtcgattccacatcacaagatgctgccggcctactaattggtagtgcaacacaagggtatggtcttagtactactgtttctaactgtcatgtcagtggaactattgaaagtaatagtgctctgaccggtggtttggcaggttataatagttatggtacttataaagattgtagtacagatattacgataaatggacatggctgcagtggtggatttatcggaagcgatttctcaggtaattatgagaattgtacagcaaaaggaaatctgtctggtaaatggagcgttggaggatttgccggaatattattttggaaaagtaaagcaaagcattgtattgcagatgtaaaggttactgcaaatgactggaatgcaggaggctttgttggttacatagaagataatgtaactattcataattgtatttcttatggtgatgtacatagtaaggtgaatggatgggaacctaaggtaggaggatttactggcataagtaatctgaattgttctattgataatagctatgcagcaggtaaggtgactgctgaatctacaaattataaagcaggcggttttgttggttatgataagggtggtacggttacttcctgtagttatgatgcaaagaagaatccagaattaaaaggtgtaggacaaacagaaaccgcaggaacgaatagtatccttcctcaggacaatattcgttctattatctgcaccgcttattatggagatcatgactgggatgaatcaaaggaaatcataaaggagaaaccaactgatgtaaaagaaggcagtaagggatatctttgtaaaagatgtggtgattataaagaaatcgctaaaataaaaccgattttaccttctcataaagcagatattacagatcttaaagtgaatttgtcagagacagaatacacttataacggaaaagtaaaacagccagcagttattattaaggatcaaaacggtaacgtgatttcttcagcgaattatactgtaacatatgcttcgggaagaaaaaaaccgggaacatattccgtacagattactatgaaaggaaactatactggtacacaaacagtattgtttaacattcgtggtaaaaagatgcctgcaccgaaattaaaagctcattcaagggctttaaaagttacatggaaaaaacaaaaagcaatcacaggataccagattcagtattcaacaaatgcgaaatttaaaaagtcaaaaacaaagatagtaaaaatagcaaaaggtagacagacatctaagcttattaaaaaactaaaagcaaggaaaaaatattatgttcgtgtacgaagctataaaactacaaaaattggaggtaaaacctataacgcttattctgtatggtcaaaaaccaaaaaggttatcgtgaaaaagtaaggaatatttatttttctatgacagcggttctgtgcaatagcatggaaccgccgtttttatttttcataaaaacgcaactcatttgtattttcttcttgacttttctcttgaaaatgtctagaatatgaaattgcaatcgacttgcgttttttaaaattataaggaaaaaatggaattacaaagtagtaatgctcgtaatgctatagaaaagctggttaaaggacaggacaggaaaggaaagcgatttatgaaacggttatttaaaaagagaagaatgttatctgcaagttctctgttactgacgagtttttttctgtgtctttttttatcggtaggttgttctgtgataaaaaataacgcagcagagactccaaatatttttgtcaatgaaaaaaaagataacaatgcagaagaggatgttatggataagatttctagtgataagatttcaattgtctgtactacttttccgcaatatgactgggtgaaaaatattatcggaaatcaagagatgcgttttgatataacattattactgaataatggtgtggatatgcacagttatcagcctacgatacgtgatattgcaattgtcggttccggggatctttttatttatgtcggaggagaatccgatgcatgggttagggatgctttaaaagaagcgaagaataaagatttaaaagtaatcaatcttatggatgttttgggcaattctgtaaaggaagaggaagttgtagaaggaatgcaggaaggaaaaggctttttgggacattctcataaagaaggagaagaagcagatgatgtggaagaagaaccagaatatgatgagcatatttggctttctatccggaatgcagaagtgcttgttaaaaatattgcacaagaaatagcaaatattgatgcccaaaatgcggaaatttatgagaaaaatgcggactcttatattaaaaagcttgatcacttggataaacagtacgctgctacgataaaaaacggaaagtataaagcgattttatttggagatcgttttccatttcgctatcttgcaaatgattatcaactaaaatattatgcggcatttgctggctgtagtgcagagacaatggcaggatttgaaacggtaacattccttgctcaaaagatagatacattgcatttgccagtcatattaacaatagagaattcagatggccggattgcggaatcaatcaaagcgaatacagcaaagaaagatcagggtatactggtaatgaattctttgcaatccgttacaaacgaacagcttttagatgggatcacatatttgaaagtaatgcgtgagaacttatctgttttatcaaaagcattaaattaaataaagaagtattctttaattgaaaaaagattgaaacgttgtaaatattgtatcaaaatattgctattaaaaaatagaacagcaatatttttcagggaaagaggggatagagatggcttatctgacatgtaaaaacttaacattaggatatgagggacatgccattgtatcagatttgaattttaaagttggaaaaggtgattatctttgtattgtaggggaaaatggaacagggaaaagtacattgatcaaaacacttcttcatctacaggatgcgatcagtggagaagtgatggctggtgacggattaaaagcttacgaagtggggtatctgccacagcaaacggttgttcagaaagattttccggcaactgtagaagaaatcgttctttccggtacacttgcaaaatgtggatggcgccctttctacagtaaagtggaaaaacgtatggcagaggaaaaaatgaagaaaatggatgtttggaatcttcgaaagtcctgttatcgaaatctttctggagggcagaagcagagaactcttttggcaagagcattatgtgccaccagtaaggtgattttattagatgagccggttacaggtcttgatccaaaggtaacagcggaattttaccaggtaacaaaagatttaaatgaggagggaatcgcagttattatggtttcccacgatgtgcaggcacttacttatgcaacacacattcttcatatggatcaaagagattctttttacggaacaaaagaagagtatatgaacagtgataagtggaagttatttaaaaacacagaagaagacagaatagggggagagaaaaaatgacacatatcttgcaggagctttctttttatctatcctacccgtttgtgcgatatgcattgatcgtcggagttttaattgcattgtgttcttctcttttaggagtaacacttgtgttgaagcgtttttcttttattggagatggcctctcccatgtcgcttttggagctatggcagttgctactatttttaaattagtaaataatactatttttattatgccggtaacaatcattgcggcgattttacttcttaggaccggacaaaatacgaagataaaaggtgatgctgccatagcgatgctttccgtaagtgcactggcagtaggatatcttgttatgaatattttttctacatcggcaaatgtatcaggagatgtctgttcaacgctatttggttctacaacgattcttacattaacagaaggggaagtgattagctgtattattatgtctgtattggtcgttgcatttttcattttgttctataatcgtatttttgcagttacatttgatgagaactttacaaaagcgattggaaaaaatgcagaaggctataatctgatgattgcagtaattaccgcagtaatcattgtacttgcaatgagcctggtcggttcccttctaatatcagcacttattatatttcctgcactttccgcgatgcgtgtagcccggtctttcaaaggtgtggttgtttatgcagcgattctttctgttattggtgcattttttggaattgtgctttctattttatgctctacacctgtaggagcaactatagtaattcttgatctgatcctcttttttataaattgtataattggaaaaataatgggaagatgataaaaaacactattaaaatatcattattgtaaattcggtattattgttaaaatggggagagaaataatatttaacagaaattttaccaaatatttctgaaaagagatggacatataactacaaaaaatatataatgagtataataatgagtaaaatacgaattatgggcagatcagtcgaaagtctgagacgcgaagttagaggtcctgtaacatggcagtaagctactacgtttaaaatgcattgtctgaagagacagtgcatctttgtttttgcaggtgcattttcagaaataaagggagacgatgtatgaaaaagaaaaaatggaacagatttcttgctgtagtgttattagcggtgatggtggcatcgcttttatcaggctgtgggaaaaagagcagggaacaggaaaataaagaaacgattcgggtgtatttgtggactacgaatctgtatgagaaatacgcaccgtatatccagtctcagcttccggatgtaaatattgaatttgtagtgggaaataatgatcttgatttttatcggtttcttcaggaaagtgatggtatgccagatattattacctgctgccgtttttccctgcatgatgcgctgccattacaaaatagtctgatggacttgtctactacgaatgaagcaggagctgtctataattcttatcttaacagctttatgaatgaggacggcagtgtgaactggcttccggtttgtgcggatgcgcatggatttgttgttaataaagcactttttgagaaatataatattccccttcctacagattataaaagctttgtttctgcatgtcaggcattcgagaaggtaggaattcgaggatttgctgctgactatttttatgattatacttgtatggagacgctgcaggggttgtccgcctcagaactttcctctacggatggacgcaagtggagaaccgcatatagtgatccggcaagtacggaaaaagttggacttgataatgttgtctggccagctgcttttgaccgaatggaacaatttattaaagatacaaaacttggaccggataatcttaatcttgattacgatacagtagataatttatatcagaacggggaactggctatgtactttggaagttcttttggagttaagaaatataaagatcagggaatagataccgtatttttgccgttttttgaacagaatggagaaaagtggataatgaccactccttattttcaggttgctttaaacagtgaattggaaaaagatgagacacgcagagataatgcgatgaaggttcttaaggtaatgctttctgcaaaggcacagaatataattgccgatggacaggatacgcttagttacagtcaggatgtacctcttcatcttacagattatctaaaggatgtaaaatcagtaattgaagagaatcatatgtatattcgtattgcttccaatgattttttcaatgtttcccaagatgtggtttcaaagatgattacaggtgaatataactctcagcaggcatacaaagtttttgattccatgcttcggcaatcgaaagatacttctaacgaaaaagtagttttgaactctccgaaatcatattctaattatttttatagtgacggaggaaatgaatcgtattccgtaatggcgaatacactgcgcggatgttataaaagtgatgtcttacttgcaaccagtaatagttttaccggcagtgtgcttcaggcagattatacggaaaagatggcgggaaatatgattatgccgaatggtctgtgtgcttataaaaagaaaatgagtggtgcagaattattggaaacagtccaatcttttgtggaaggtacaaagggaggtttccagccttttaataaaggttccttacctgttgtcagtggaatttccattgaagtaaaggaaaagaatggaaagtatacgttgcttaagattaaaaaagacggaaagcagcttaaggaagaggatacgtttactgtgacttgtcttgcaacagagaataatatggctccttttcttacagatgaggatcatgaatttacagaagaggaacagcgggtaaaagatacttgggtggattatgtgttacaaggtaatgccgtacttgcagagcctgaacaatatattactttgagggaataaaaatgactgatacgaagtatagtatgaaaatgaagaaacagtttaaaagtaaacgagcaggaaccttacttgctgctattgttttacttgttggaattgttacggtcagcatcaaatattttaattttgtatcgcagacggtttatcatgaaagcgtttctcatttgactgagattttccatcaatcaaacagtgcattaaatgagttagtcaataaaaatctgacgtatcttcatatgtggagtgaatatttacagaatacttcaagtgaaagtgaaattcgtgattacatagataaagcgcagaaagagacggagttttccaacttttattttctgtcagccgagggaaattatcaaacggtggcaggggaaacagggtatcttggattacagggaaatcttgaagatcagatcacacagaagaaagatattatcatgaacgcaaccttgcctggaaagccacagttacttgtgtttgcctgcccggaagtttctggaacttatcagggatttgcatacgatgctatcgcagttgcatataacaactctgatattgtaaaaatactggatatcgcagcttttgatgggagtacaagcagttatgtcattcaatcggatggacgtgtcatgattaatcatgctgtaaatacacaaaaagatgtatataactttttggcatttctgagagaacattctgatctttccgaagaggatgtcctcgcccttgcaaagaaatttcaacaggaaaacagtggtgcaatgcttgtaaatctggatggaaagaaatactatctgatttatgaagccgcagaaattatgaactggacattactgggcattgttccagcagatgtagtcaatgcgagtatgaataatctacagtttaagactatgtttattattggtgggattgtattcagtgttgcggtcattatcattataatcattctaaaagaaaaccggttgcggctgaagagaaaagatacggaaattttgtacagagacgaattgtttcaaaaattatcgatgaatgtagatgacattttcctgatgattgatgcaaagacatctaaggtagattatgtgagtccgaatgttgaaaaattgcttggtatcacagtagaagaagttcagaaggatattcgtattttggaaaaattgcatccgaaagattctgaaggagagaagtcaaattatctggaaaatcttttagcagatgaacagcgagaacaggattttgaatatattcatcagaagagcaaggagcggcgatggtttcatattattgcaatgggcagcaatgtagaaggtaaaaagaaatgtattctggttatgtcggaccgtaccgctgataaaaaaatgaatcaggcgctttcagaggctgtacgtgcagcagaaactgctaaccgggcaaaaagtacatttctttccaatatgtctcacgatatccgcacaccaatgaatgcaattattggttttactacactggcagtaagtaacatcaagaatcaggaaaaagtacaggactatttaagcaagattctctcatccagtaatcatttgctttctcttatcaatgatattttggatatgagccgtatcgagagtggaaagatgcatttagaagaaacagaagtcaacttatctgatctgcttcacgacctgaagacgattatcggtggacagatccatgcaaagcagctggaactttacatggatgtaatggatgttacagatgaggatgtgtattgtgataagacaagactgaatcaggtgttgctgaacttgttatcgaatgccattaagtttacccctgccggtggaacagtttctgttcgacttaaacagtatcaaggtacagataaagaaagaagtttatatgaaattcgtgtaaaagatacgggaatcggtatgagcccggaatttgcccggaaaatctttgatccttttgaacgtgagcgtacctctacagtgagcaagacgcagggaaccgggctgggtatggctattactagaaatattgttgatatgatgggcggaacgattggaattcagacaaaacagggcaaaggaaccgaatttattgttcggttgccattacgtattcaatccggtcatcgtcatgtcgaaaaaattgcggaactggaaggattaaaggcgctggtggtagatgatgattttaacacctgtgacagcgtgacgaagatgttaataaaagtaggaatgcgttcagaatggaccctttctggtaaagaggcaattttacgtgcccgccagtctatggaaatgggtgatgctttccatgcatatatcattgattggcgcctgccggatatgaacggtattgaagttacacgccgaatccgcagtttgggggatgataccccgattattatacttactgcatatgactggtcagaaattgaagaagaagcaaaagatgccggtgtaaccgcattttgttcaaagccgatgtttatgtctgatctgcgggagacattgatgactgcattaggtgaaaaacaggatgagattcacgatggtgtattcccaagtgtaagttcagaatttaaaaataaacacatactgcttgtggaagataatgaattaaatcgcgagattgctctggaaattcttacaaattgtggtttctgcgttgatacagcagaaaatggtgtggaagcagtagaaaaagtaaaaaattctacagaggagatgtatgatttggtactgatggatattcagatgccggttatggatggatacgaagctacccgccaaattcgtgcaatcaatgattcagcattaagcagagttccgattattgccatgacggcaaatgctttttcagaggacaaacagacagcaatttctgtaggaatgaatggtcatgtagcaaagccaattgatataaatgtgcttctgccaatgatattaaagtatattaagtaatgttaaaccgattaaaaatagagttaatataatagcatcgtataattttcatataatttcccttgacaaattagagtagcttggggtatagtatgttccactttgacgataaattcattatatgaaatgagaaaaggtgggaaatttatgacattttatcaagagctgcagcttagctcaactggttcaaaagaattaattaaaaagacaacagacccaaaggaaaagagaaggcacattttaatttataatgttaaggtatatcttgtcgtagccttctgttttgccttagtaacgctgtttagcacagtatttggttccggaaatagtgtagctggtgtagttgtcttattagcattacttgttcttcgacaggcagatttcggaattaaaacaacacatggtcttttgtgcattgcagggatatttggaattcttattgtaggaccaagacttactaacactttagccccgataccggcattttttatgaatctggtcttcattatgttattaatgattcttggctgccataatatcattatgttcaatcattcgacttttgtgttaggatatttattattacagggatatgatgtgacaggcgaagaatatattttacgaattgctagcttactgattggaatgatcatttgtatggctgtattctataaaaaccagaaaaaccgcccatatcgcagaacttttcttgatttattccgagaatttaatcttcgttccgcaagaaactggtggtatgtacgcctgactgtaattgtttctactgcgttactaattatgtcattattaggattaccgcgtgcaatgtgggcaggaattgcctgtatgtccgtctgcctgccattttccagtgatcttgtggcaagagcgaaactaagaggaccatataatattttaggctccctgatttttgtagtcctttatcttgtactgccaaagtcaatgtatccatatatcggaattatcggaggaatcggtgtcggttattccgcaggatatgcatggcagaccgtatttaatacctttggagcattgtctattgcttctaacctgtttggcatgaccggagcagtaattcttcgtattggagcgaatgtatttgcttctgtttatactgtagtaatagacaaattattaaataaaattttcaaaaattcaactgagttatctccagaatataactcgtaaaaagaacagtataaaaagatataacacaaagatataaaaagagctttacataatcttattggagctctttttttgttttatttttatataataaaagttaaacaggaaattaaatagacaatgatatgtaaaaaatgtataataaaaaagagattagtaagttaaaatcgtaaaaaattatttttagaggagaacgggagaaaacaatgaaggcatatacatatgtttcagaaggaaaatttgaactgacggaaaaacaaaaaccggttcttatgcatgaacgagatgccattgttaagataacacttgcaagcatttgttcaagcgacctgcatattaaacatggtagtgttcctcgcgctgttttaggaataacaattgggcatgagatggtcggagttgttgaatcagttggcgatgctgtcactcatgtaaaaccgggagatcgtgtaactgtcaatgtagagactttttgtggagaatgttttttctgtaaaaaaggctacgtcaacaattgtacgaatgagaatggaggctgggcccttggttgtcgtatagatggcggacaggcagaatatgtacgcgttccttttgcagatcagggcttaaataagattccggaaaatgttaccgacagacaggcattactggtaggggatgtccttgctactggctattgggcagcgcgtatttctgagattacagaagaagataccgtactcattattggagctggtcctacaggtatttgtacattactttgtgttatgctaaagaaaccacagcgtatcattatgtgcgaaaaagatgaagatcgccttcagtttatcaacgaacattacccggaggttcttactgtttcaccagaagaatgtgcagactttgttcaagcgaatagtgagcatggcggggcagacatagttttagaagtcgcaggagcagattctacatttcgactggcatgggaatgcgccagaccaaatgctattgtaactatagttgcactttataatgaagcacagacattaccgcttccagatatgtatgggaaaaatcttacatttaaaacaggaggagttgacggttgtgactgtgagaaaacactgaaattaattgcagagggcaaaatcgatacagaaccactgattacacatacttatccccttagtaggattgaagaagcatatgaactctttgaaaataaaagagatggggtcatcaaagtagctgtggaatgttgatgagaagcttttttagaaagaataaaaacagcagatatggagggtaaaaaatgcagacaataacatcagcttacgcaaataaaatgcttaagagtttggaagaagataaggctttctgggtaaataaagaagcagcatcaagtacgtatgtcgctgctattaatgaggagccggttataccagaatatgattattcagaagtagcatccatgattacagctattgatgaaaagattgcgatcatcaagcatgcattgaatgtaacaaatgcaactgcaaaggttcaggtaggtaactcagaaatgagcattgataccattcttatcaagatggcgcagttaaataaaagaaaaggtgtactggatcagatgcgtaaacagcttccgaaatcaagacaggaacaacattcctatacatctagaaatactgttccggagtacagatatatcaactacgatttggaattaataaagcaggagtatgaaaatgtatccaagaccattatggaaatgcagatggccttggataaatacaaccagacggtacagtttgaagtagacatctaaaattactttccgtacagggcatcttgaaattgataatggttcaagaagtttttgttcagagttaaagtgtatctgttataagttattcgttatcggttttatgttcaaagaaaagataaaaaggatgtaattttttaacagagccttgtagaaaacctgcgtgtggaggttcggttctaagcacaggctgcgggaaatccaaagatttcccgcagcaatttttatttatgctttcagatgaagaactctccctgtagcaaatcagaattattgtttataccaaaactgtagaatcttataagtccatcttgtcggtttacttaccggatattttccaaagtagattttaacagtttttgatttaccaggttttaggtttacagtaagtgtttttgtcttttttgggcggcaatcatctaaaacatcatcaaagaataatgtagaagacagcttaactttggttatagggtattgtgttttatttgtcagtttaatttttacagtagattctccatgtaagtttccataatcaagtcctgcttttttcgactttagttgactgaatttcggttttggcttcgccttttttacagtaatttttattttctgtttttttccattaatagtagcagtgattgttgcttttccagcttttttaggaattagtttttcaccagatacttttataatttttttattgcttgattttattttctttatctcaggtttatttcctcgaaatgtaataaagtgacgaatagaatatttctgtcccgttgtcattgtacccgttttatcactaaaagaagcaatggacttttttaccgtaacatggataactttagtaatcgttttgtacttaatagttatcgcagccgttccaactttttttgcagataattgaataccaacatccatatcaggatcataagaaccaaaatccatgttgtctactccaaaaatatccacaacggaaggatcagaggaagtaactagtacattataggatgggactctctgcacatccggatcatttattttcgcaataattacattgtaatcaccgggatacatattttttaaatcagcaatccgggtcgtatcaagccacatttgtaaattagaatcccaggttccttttgcctgtgccggagcagagaaactcagacacagaattaaaagtgggataagtaaaaggattcgttggattccaaagatgaaatataaaagattctttaattcctgttcactttttttgtttaacatgttcaatttcccctttttatgaaatgaatttccggagccctcccttcatttgcttttataggatcgttataactgccgatattcttatcagtgcaaatataatagccagtactccgattccaaaaaacaacaaactaaagaagcgattacctccacctgttatatcgtttaaggtttctgttacatctgctggattttttggattataatatccaggatattcttttccgataggatactgatcgatagaacttcctatacgggtatgatattcatattgttgaccatttaccgtatactcgtaaactggagtatacgaggtgacagaaattctgctttctggtccctgttcgtttgaatttgtttcttcccattcatttttttctactctgattacacgcaatgtggtatgtcctgtgtaacgctgctgatattcttcattttttttagctgcgttgttccacattttttttccaaaccagataaacaggaatcctaaaagcaacgggagtgccgctaaaataaaagaataaatatgaaaatatgtcatagttcccctcctttttatatcttattttaaaaatagtttctatatgttcattataaaaaaatatttttataaaaacagtgtcttacagtcactatttcgttgaaaatggatactcatctgcaaaaacggtatgtccactggaatcatttgtaaataatgctggaagtaaaaagaaaattatgctatagtaaacaagacaaaaaatatagtagttactggagaaagttacatactttcataaataaaatccttttgtttgccataagcggaaacccactacctttaggtggtgggaggagccttgtaaatctttagtcgttaaccctgattctcaatatatttttgtatagtggctgaagatacttctccaatgctacaaacaaaatatccgtctgaccaaaatatcttcttcttccaatactgtttagatagaagcgaaccatatttgtgccataaataatacgttgtttcttgctttacaattttgacaatatcgcaaactttagctgttgtatcgtaacttaataagaaatgtatatgatctttgtcggtttctatagcaataatttcgtagccataagcattcgcaatatcgaaaatcttttgtttaacatcatcagcgatagaatcttt

SEQ ID NO: 427 - DNA, 32160 bp, Eubacterium hallii
atagaaatttacttccttattttcgtccgcccaattatatgttataatcataacaatagcgaggataaaacttttttgagaggagggggattgccccatgcatatttctattccaaaacatgcctctgatattataaagacactttcttcccatggttatgaagcctttgttgtcggtggctgtgtaagggattctattcttggcaaagagccggcagactgggatattacaacttccgctctgccggaacaggtgaaggctttgtttccaagaacaatcgatacaggtttaaaacatggtacagttacgattatgatggataagatcggatatgaagtgacgacttaccggattgacggaacatatgaggatcaccgccgtccgaatgatgtgacttttacttccagcttaagagaagatctgatgcgtcgtgactttacgattaatgcaatggcatataatgaagagaagggtcttgtggatttatttggtggcattcaggatctgaatgaccgtatcatccgctgtgtcggcaatccaacagagcgatttgatgaggatgcgctgcgaatgtttcgtgcggttcgttttgcgggacagttgaattttaatattgaaaaagaaactttagctgccatcgaggcacagcatgcatttcttaaagatgtcagcgcggaacgtattcagattgagctgttaaagttattgatttccggacatccggaaatgattcgagcagcttatgaaaccgggcttacaagtgtttttctgccggaatttgaccggatgatggaaactccgcagaataatccgcatcatatttattctgtcggtgaccatacgattcatgcggtagaaacgattgctccaaatccgattctccgccttacgatgctgcttcatgatatcgcaaaaccagagacccgctctacggatgagaatggaatcgatcatttttataatcacaatgaagccggtgccgtacttagtaagacgattcttcgccgtcttaagtttgataaccagaccatccagatggtcacaacacttatcgcccatcatgatatccgttttaatgatgctttaggcacaggacggaagcatgtacgccgggtgattcattctgtaggtgagaatctcttcccatatcttcttgacgtgatggaagcggatatttctgcacagagtgattttatgcgtcttaaaaagcttactgcattaaaggaaacccgtcaggcttatcatgaaattcttgcggcaaatgactgtcttactttaaaggatctgaagattaatggaaatcagttaaaggcgcttggcatttctgagggaaagatcatcggtgcgattctgaatgctttgctttcacaggtgctgaataatcccgagctgaatgattatgaaaagcttaaagaacttgccttgaaaatttatcaggaagttcaataattttacacataacatcccttctttatacataggatagaccatatttaccactgtgtaacccattgtctgtcttatcatgtactttcggaagcttttttcacttgcttttgtgagaagcaagtgcaagaaagactctgagattacatcctatgttaatggagggatttttttgagtgaaaaatacaaggaattattagagcagtacgatataaaagttctgtccacttttcgaagccgcggaactttccagtgcgagacagagcagggacttgccttattaaaagaatatcatggttccctccagaagcttgctctggaatacgaatggaaggaaaagcttgccgaagcaggctacgccgctactgaccggtattttctcacaaaagaagaaagcctggtcacctatgaccgctaccgaaccgcttttattttaaaacattattttaaaggacgggagtgtgactgccggaatctttcagatgttgctgcctcctgccggaatcttgcatttttacataaggtttcttcctctattgaagagattccttttgaaaatctgaaaacagagtctactagccatctctttgaacgaaaaaaccgggagcttcgttcgattcgaaagtttattggtcatgtccatggtaaaaatgattttgaacttctttatatgaagtgctttgattctttctacgaggaagcttcttatgcgctttcccgccttcttaaagtcgaaccagaacttgccgataccggctgtggcgtatgtcatggcgcatatcattatcacaatgtactaatcttaccggattattctgtcgcaactgtaaattttgaatctatgtgctatcagccctatttacttgacttatatctttttcttcggaaaactttagagaaaaatcattatgactattctttttttgaggcgggtatttccggctattctatttaccgccgccttgccgaaaaagattttcttttcttatatttactttttttatatccggaaaagttctggaaaatatccaatcagtactacaatcaccgaaaaagctggattccgccaaaaacgctggagaaattgcagaaggttcttgcacagaatgaggaacggcatacttttctaaagcaatttgctgcatttttaaatactttggataaaaattttttataataaaagttcatttattcgtgaaaagctatagttgcctgtatccctataaatatgctaaaatgttttaagcatatttttgcatatttttttgggagagtgagtgattcgatgggctatatggctttataccggaagtggcgtccgaatgattttgatgaagtaagaggacaggatgccattgtccagacattgagaaatcagattatttataaccgaatagggcatgcctatcttttttgtggtacacgaggtactggtaagacttctattgcaaagctttttgcaaaggcggtaaactgtgagcatccggtcaatggaaacccctgtaatgcctgtccttcctgtcaggcaattaacgcacaaagttctcttgatgtactcgaaatcgatgcggcttctaataacggtgtggagaatatccgggatatccgggaacaggtacaatattcccctgttgagggacgttataaagtatatattatcgatgaggttcatatgctttcttccggagcatttaatgctctgctgaaaacgctcgaagaacctccttcttatgttatttttattctggctacaacagaaaagcataagattcctgttacgattctttcccgctgccaaaaatatgattttaaacgaatttctgttgatacgattacaggtcaccttgtatcgttgatggagaaggaacagattgatgcggaagagaaagcattacgttacattgctcgtgctgcggatggttctatgcgagatgcgttgagtcttcttgaccagtgtatcgcattttatcttggacagacgcttacgtatgagaatgttttagaggtgcttggcactgcggatacttctgttttcagcacattgcttcggagtattttaaagaaggattccatgtccgctcttgatattattgataccatgatcactgaaggacgggagctttcacagtttctttctgattttctctggtaccttcgcaaccttcttatattaaaggatcaagaaggtgcagaagaaagccttgatatgtcaaaagaaacgattgctgccttaaaagaggaatgtgccatggtagatactactgctctcctgcgttatatccgactactttccgagctatctaaccagattcgaactgccacacagaagcgagttcttttagaagtcggctttattaagctttgccgtccagaaacagaatcggatgccgaaagtctttccgaacgtgtccggcagttagagaccatacttgcacagggacttcctgtgattcctgctggtggtgcagggaataacagtggtattaacccgtcttctggcgcagccattggaggtgctgcaaacggcggtgtatctgccggtaacagcgcgtcacaaagtcaggcagcgcagatttcaccagaagaagcgttggagaagcgtttttctcctgcggaagcggaggatttaaagaaaatagcgaaccgctggaatgacattgtcaatcagtcatccatgcctatgcaacagtttcttcgtgcggcaagagtcgctgttgcggacaacagtactattttacagcttgttttctcaaacaacagccttgctaaagaatactttgagcgggaacatcacaaaaatctggaccttttatccgaacttgttgcagaacagactggaaaggtcgtaacatttgaatgtacgtctgactcccatcagccggcagaacaatcgaactatattgatctaagcaagattcatcagacggttatttttgaataaatactctaaaatattccgttattccatcgcagattctgcagtgaatttacgcatctttatgtatatctgcgtgtgatatatgaatttattaattatttattttttatggaggtttttattatggcaaaaagaggtggattcccaggtggcatgcctggtaacatgaacaatttaatgaaacaggctcagaagatgcagaagcagatggctgagactacaaaggctttagaagagaagacttacgaagcaactgcaggcggcggtgttgtttctgttactgtttccggtaaaaaagaagtgactgctattaagattgctgaagaagtggtagatcctgatgacatcgaaatgttagaagatcttatcatggctgctacaaatgaagcatttcgtgcgatggaatcagattcccaggctcagctttctaaattaactggcggccttggcggaggattcggattttaatgaattattatagtacccagattactaatcttattgatgaactcagacgacttcccggtatcggcagtaagtctgcacagcgtcttgcttttcacatcataaatatgccgaaagagcatgtacatcaccttgcacagacacttgtcaccgcaagagaaaagatccgctactgcaaatactgctgtacactgacggattctgaagtatgtccaatctgtgcgagcacgaaaagagatcacagtacgatcatggtcgtagaacatacacaggacctggctgcttacgaaaaaaccggtcagtatcatggtgtttatcatgttcttcagggaaccctcgctccaagtcttggaaaaggtcccgatgatattcgcttcaaagaacttgaagaacgccttaaaaatccagaagtaaaagagttgatccttgctacaaactccagtcttgacggagaagctactgcaatgtacatcaccaagaaggtcaaacctcttgggataaaggtgacccgcatcgcaagcggtgtccctatcggcggtgaattagaatatattgatgaggtaaccctctcaagagcgctggatggacgagtagaactttagatacagattttaatatagcactttaaatataaagatttaaatacaggactttaattgcataacttagattactctcttaaaaattctttgtaacagtatttgcggatttttaagagaccatcagataagaatgggagatgactacgatgaaaagaattggtatgctgaccagcggtggagattgtcagagtttaaatgctaccatgcgtggcgttgtaaagggtcttaacgtccttgagggaaatgttgagatttacggcttcattgatgggtataaaggattaatttacggcaactacaaacgactgacttctcaggatttttcaggtattctgacaactggcggtacaatcctcggtacatccagacagccttttaagttaatgagaactcctgatgaaaacggtcttgataaagtagaagcaatgaaggcaacttaccgttaccttgatttagactgcctcgtcattctcggcggtaatggcagccagaaaacagcaaaccttttaagagaagaaggccttaatattgtctcccttccaaaaacaatcgataacgacctctggggaacagatatgactttcggtttccagagtgccgtagatatcgctacacagacaattgaccgtattcatacaactgcagcttcccacaatcgtgtatttattgtagaactgatgggacataaagtaggatgggttaccctccatgccggaatcgccggtggagcggatatcattctcatccctgaaattccttatgatcttagacacgtcattgaagctattaaacgccgtaatgaacagggaaaacagttcactatcctggcagttgcagaaggtgcgatttcaaaagaagatgcccagctttcaaaaaaacagtacaaagcaaagcttgctaagcgtaaatattctaccgttggttacgagcttgcttcacagattgaaaaagcaaccggtcaggaagtacgtgtcactattcctggtcatacacagcgtggcggaagccctgttccatttgaccgcgttatctccagccgccttggagtggcagctgcagaactgattgctaaagaagattacggcaaactgcttatcatgaaagggtatgatgtaactacacttcctctggaaaaaacagctggaaagttaaagtatgtctccccagatgatcagattgtgcttcaggcaaaacatcttggaatctcttttggggattaagttcaagtcgagccgctgcgagacttggcgcgtgattctggtcagcgtaagctgacatattctttacagaatcactgcgcatcctcgcggagcgtttatctcagtcggagattggactctcactgagacaaatttgctatcactcaccacctgaaagaggtgggagtcttctcgactgagataaccagaggctgtcgcaaaacagcctctaaccctatgccaagaactgtttttgctcccataggttatggtacaccatggaaaaaggaaaagatgaccttactataaaaaagcctacgaattcaaatctatctattcttacatagtaatctacttaacatagtgagtagaaatcctcctataagtcctcctatatgagctgcattatccactccattagagaagaaaccatacgatagtgcggaacagaccatgaagatcattcctgttaatccgatttcttctactctgtgtctctttttctgaataagatctgccagaatacagaatagcagtccacccataactccaaagattgctccggatgccccagctcctactgtgtttggactggcccccagggtaaaaattactgaggttaccgctcctgctaatcctgctccgatatatataataaaatatgccagctttccggtgattctttctaatctgcatccaattaataataaaatgagcatattctggagaagatggtccgctccaaaatggagaaacattgatgtgaacaggcgataatattgtcctttttctacaatatctacccaatccatcgctccatgtgcagccataaattctgcatttgttgtatctccgaaaaagctcaataccgcaaagacgagcacgttgataagaacaagtatcgtattcactggtgttaatatctgatgaagttcttttttctcttctgctgcttttttttgcaaaaatttctgtgtaaatggctctagatcattttccagattataatattctgatttttgatactcataaatatagagctgtcctgcctttatgtcaaaaaaccatacatccggataactttctgcttcttttctttcctctgtatctggctctccctgtttcagtatcaatagcagatgttctacttttttctggtactttatcataatctgacgttcgatatccgccatttctctttcccgttgttctaacgacatctttttctgtcccggtaataccggaggaacaatctcaagcagcgataactttccattggtatcctttccccataaaatctttgaatcatattttattctctgaaatccctggtgaaataagaattcctgcaatgcttctgtaaattccataaaatctcctgcttacctttctttatcttattatccccattatataagggatggtattttagtgcaagagaccgcatactgtattactggattgttgtatgttccaacagaaatctatattctttttgtgcaaagcgcaccgttgctccttcttgtaatctttcctggctgcctttttttatttttcttccgtctatccacgttccatttgttgaatctaaatctcgcagaatatatccttctcccccgttttcgtaaaaagcttctaatatcactgcatgttctctgcttactgttttgtctgatatttttaactgatttaccccttctgcactgccaatgtaaaacggacagctttttatgatagaaacaatgccggtttccatatctcgaagcatcggataaaaagattctttttctaaactcaaaatagttgttccttctccctcggtattccaatctgttttcacatcccattctgcttctgtttttactgacatagctctatttcctcttctattgtattgctctgcattatcattttctctatttttcttattataatcagtcaaacatgtctctggcgcttttctgattcgtctaagttctctaaaacattttaatattgcaagtacaaaggctgctataaataatattcccccgatacaatatctgagaagaatttctgtaaatccttttgtgattccggaaactatacaaatactctcaaacacaattgctgcgatactggcaattccgagaatactaagcaagcttatatatataaacttctgatgcgatggttttttagcatttattttctgaatagcggttttatctgcctctttaaagtattctctttccggttctttcactctttcctctgctaagtcttccctgaaaaattcttcgtatgaatttctttttatatattcttcctctttttcttctatacacagataattttccaataattcttttgaaaatcccaatttacgaactttgttatacaccttatatatataccgcactgctttatcatcctcataatctatctggatgagcatccattcaaagaaagtttctattctggcctggaggttttccctatatgttttaggactgtaaatccactgcatcgttccgtctgcactttcataaatatattccggtgataattccacataattcaggttcaacatataatcatctatttcctgtattaaatcacttatactctgcagaatccttttgcatttatcctgtgataacggttcatttttttcctgcatttttaatgatcttcttcctgttatgtcaaatagcagacttttttctccatctttttcccgaagctgtaccggcaccagcattcttagagaattacgcttcaacacttcatattctacagataaataataatccaacccacaatcggtcatgttctgttttatttcaaaaccgacatcttctttatctgatatttcgttatctagtatttccttatttaatatttctttctgttcaattacacttaacagataggtatgtgtcccttcttttacaatatccacaatccctcacactctctcctcttctatttttgtttgtctttttatctgtttgtgcattgtttttgatttttatttctgtattgtaatctttctttattgtaatctttttttattgcaatttttctttattacaatctttctttgattctttatttctttttacttcttcgctgtctgttttctaagaagttcctcttcattgcttataactgctttttctttgcatgtaaatgtccatccagctgctcccatatactccctgctcccccacacaggaatcaaaaaccggatcgatgcacttgctgatactttatctcctgaaaaactcactccgtttttgcacaaagttgtaccacttaaacgtgttgaaattctttttgtcagccttgcttttgcctttccgataagctgacctctattattatgtcgaagaaaatttttattacgacttaataattgctgtggcttatacgttccatctatcagattcccatctgtcttccatacatctgccgtctcatcggctagtcgaatcgtctcgctctttactgacgatatatcaattagaaaaataccaaagaatatttctataacgattatcatcaaaataatcggtacaatgcaggctgcttctactgtcatcatcccccgattatccatttttctcattcctgtcataattacctcccagaagcacagcgtgaacacggccgcatgtttccgacatcctttaactttaccgcttttatcgttctttttaatccactacatcccagtgtagaatgatagcagtccccataggccgttacaaataatgccgatggatttttccctttctttatacacttctcacaggcagcatattttgatgaatgaagaacttcctgtattgctgcactgccggtaatttttaaacagatatgtgagcaggaagaatctttatggtatactactccattttctgcaacataaacaatctgattatccccggcttcctcatattctccccagtgctttacatatcctgaaaatatccttctttttaccgttgttttttttcgaaatcgcaatcctgaaaaaaagggtaccggaacctttaatgtatatgccgcttttatctgcagttgttctccctctaataaagtagaatgtattgaaattcctctcttcccgccatcaataagattctcacataaggaaccgccttcatatatcgaaaaaaacactcctcttgcattctgcggctgctgtacgactgctttctgggtgcatacctttgccgtctgagatgctgcataatgtacttctgtttctattaaaaccatctgcgctaatgccataaaacaacataatacgcatataaaaacaggaaaaactaatgaagtttctacggttatcgatgccctggaggagccaaagcaggatgctctgtttctcttaagtaaaatccatctttcgactcgtgcctggagaggcttttcttttcctattaatttatttttcgaacatagaacattacacatacccaaaaaggagttttttattatgtgtcttaaaaagagcaccctgcttcaccccctcttcgagcagatactcttagaaaaaatatctgcccgattttcactaataactaacctgcttctcaaacttcatttttactgttccaaaagaaaggcttccctcccatttgtaggagaacagacagttttccattaaaaaacctgcttctttacacgctatgttttcctgcataatatccatcatgcgataacatagtattgtagaattttccttcataaaaagtaagactttcagataatccttatatgatatattgtgttttcctttttttacggccttcttttcctttaactgctttaccattgttttcagttccagattccagtttcccctgtcctttgttaatgaaatctcccctccttcaaataatgtgtgcagctccagaagagattccccgtagcttaaagcggctctcaacatcatctggactgcctttgcagtctgtggtattcccacaacaccggtcagtgccgaagccattagattcacctgggactgtatttccgcatccctgcctgtaaaaatataattatttataaatcgtaacaaaaaaatatcattcgccactcttttaagattatccagatcagagggctgtcctttgatcagatattctttttcatatgccagaacctgttcctgcacatcgttcttttcttctttttcttctctttcttcctcactgtaatctaaaaaacattcttctatatatgggacaatatagttctcttttgtccacaatgtactgttcgtattgatggagaaatccacagaaagcatactttttatcccctttaatcccaatccggaaaacaaaaattcctcaactttgtgttcttcttgttctctttttttcgctcttgatggcaaattctcctctgaaatactttttcgggaaagctgttctggatgatcggaaacataaaataaaattcctgtctttgtcagaagctgtaacgcttccttaatctccttccacgttgtacgttctttctgtacttcctggctcactgtttcttcctctgctgtatcttctactttatcttcttctactttattttcctcactttgctcaatgttacctgtttcttcctctgcttcattttgatattcttttctatccgcattgttcttttttacattatttatgagctgctttaatgtatccttcaccttctcttcctgacggtacttcatccattcccgaatttcatgtttaagataaagtccatcttcttctactgctgtcacttcttctgtcatcttaagagaattacagaagacattaaaaaatgaattccctgaaaaatactggtccatatctgccttcccatcagatagaatataatttttctctcgtggatcaagaaaaaatatatgatatttattaaagagttctctgtcataattcgcaagaatattctctccggcattctttaccgcgtcttcccccaatgcacttgcactataactggataccccttctacaacaacaaaactaaatcctataagaacaatcagcaggagagataaaaaaactgttatctgtcccttttcctcaaatatcactgtaatcttcttgctgctgtatcttaattgcccagacaaatgtctaccgaacagagcctgcatttttctgtattgtggagaaaatagatgctaccactcctttaatattcgtctgaaaaataatgacgagaccgataagaacaacgataattaatataacttccaccactcccattccatcctgggaagccagaatcatcctcagtcgatttctacctgccggcacatcctttttctcgcatcgctttgtaaatcttctttttactactgaaaaacacatagctactcctcctatctttttgaaaatctaaaatccctgaaaccgaatcaacgccggatacattacaagtaacattacctgacacagtaatacgatcatcggaaaaagtaatcgagttgcggcctcctctccttcctgctttgctctctccacccgtctttgaaatgcttcccgttcttctgcctccatcatcgttgctgcttctttagaaccctttgtaaaactttgtaccagaatcagcgccagcttttggtaagcttctgaatgaaactgcattccccagttctgacaggcttctttttggctcattccgttattcatctgctgttccataagcagcaccctctcaaacgcatactttttctgtttcgcatcggcttccttctgttcttgataatgaaaaccaattcttcgcactgcggaaagaaacgataaacccgctcccatatacaatgtaagaaggtgaacaatcacaggaaaatctttctctgcttctttacggtgtctctcgccctcttcctttagtttcaaataattatgtacaggtatacatagacacgtcacaagaaataaaactgcagctcctcttcctcctgcttcctgctgtcccgccctgatcttggcttctccataagacgataatattttaacatctgactcatgacggcttgctttctctgttcttttcaaatacttctgcacctggtaaaacgcactcttcctagaagaagcctcttttggaacaatagaaatcttatactttctcttctccttatactctcggtaatgcgctgtcactataatatatctgctataacgttctcctttatgtaactgtgtctgtacttcctcacttaacgttccgtctaaatgaacggagccgtcttccggcaattcatacgtaatttcaaacggatatcccgcaatactctccgggagatttaaagcttcacttactttatacaaagaaggattccttccccgcatctccttttttagttgtttaaaaaaagcttgatatactttttgtcgttcttttaatgaaatcttctgttcctctaacttatattgtatctgttttttcttattacctttttgtaaagaaatctggacttgctttgtcccctgtccaaagggattgcgctttagcaaaatataatccggcttgaaaatatgccaggcaagaacaaccgctaacaacagccctccaatcataacttctgtaagtataatctttccctgctttaaaagaaactgctctgtccttctatataattcctgttctgactctgcatattgttcctgcatatttctttttacattctgcttcaggcgctgtctaaaacgaaaaggaagcctgttccaaatagtatataaaaatcgttctgacataaagctttccgcctccactgatgctgatcatattttgatgattcttccttatctgtgaataccaaaacaaaggattctgaaactcctgtatactatcttaaaattgaatatccataattttatctgaccagaaaaagcatgctgctgtaataccaattatcactgacataaccagatgtcccgcaacggatttataaaaacaggcaacatattccgggtttgccaaacgaagatatactaaaataaaaaacggcatagacaacataatattcttctcaaaaatctttccgctaagaagaacccgaatctcttcttccgtatccatcttatacttcaagtgctgcattgtccttttcaaaatctccactacgttcccacctgtactttgcacaatctctatcacaaccgcaaactgtcttgcttcctccagattcgtacgctccgcaaaatccataaaaagctgttctaacgcaatatgcagatcaattccctgcacgatccttctcatctgcccaagcatcggattctgctccccttcatatagactttccagctctcttagtgcgatcctgcaggaattattaagagaatatcctgcctgaagagaagtcagcagtgactgcagcagatcctgaaaccctttctgatatagctgctgttccttctttttcttcctttctttcaatatcttaaaacagggaaccattaatacctgttccggaatcatccagtacatatctccatagcacaatatatttagcaacaataatcccagctctcctgccagaaaaaagattacattctccttgcacttatccagattgattctgtctgaagttatactgctgagattacgccctcgccttcttctgttctgcccttccttcacgaaacaacttcaccgcctcacaatacttctcatactgtccataatctttaagcttctctacatggaacagatcttcccgaatctctaatccatgatctttatcatactgaaacaatgtatgcgttttatactctgtccggctgtaatctttaatctcacttatctctaatatctttctctctccgttcagacatcttcccaaatgtataagaatatctacagaagaagcaatcaaaccctgaattgctccaagcggcatatccattcccataagaaccatcgtttcaagacgccggagcgcatcccggcaggaattcgcatggatcgaagaaaacgatccactgtgccctgtagataacgcctgaagcatcgacatcgcttccgcaccgcgaacttcaccgacaataattcggtctggacgcattcgcaaagaagccttgatcagatcctgcatcgtaatctcattcgctccctccacatttgcattccttgtctctaaccgcacaagattatcaacatgaaacaattggagttccgctgaatcttctattgtgatcactcgttcctcctgtcctatatattctgcaagtgcattcaagagtgaagacttccctgagtttgtcgccccactgatcaaaatattgtactttcccttcaccaaagcagaaagtatccctgtaagcgcttcgggaaattctccaaaagcgagtaatcttgcaatggtcattcctccttttaaaaactttcgaatagtgataaccggaccctccaaagatatgggcggtaatacgatatgcactcttgaaccgtccggaaggcggctgtccacaataggagaagcttcattcaccatcctgtttgtcggcgctacaatctgttcgattagccgatatacatcggcttcttcaaaaaaatggtctcttgttcttcttaccctgccattctgctccacaaaaatgtgagaagctcctataaccataatctcactgatactgctgtcttctaaatacttctcaagaacatcaaaaccccggatggaggaaaacatctgccttcttagctcttccttctccgaaagtgttccatatccactatgtcctgaacgcaaaatagccttatcaatctctctatacacatctgcatcactgacataagacgttcttccatccatctgatgtaaaatctgttcccgaagttctctcctaccaggcagttccattcaaaatatcctccctgtatacacgtttccatgattcctgaccagaagcttccctacgagaattcacagattcctgacacaaagtattctgatgaaaagactcctgacactgctccttctgctctgctgccccctgatgaaaacttctgagattcagcactttttctaagcggtcacagaagagattcagacgtatattctctctcgaatccaacaaaataatcctgtcaaaacagcgcagtatatccagatctgatacaaagcccattccggctccccaaaatacttccctgtatgtcccctccttccttaccttgtcaaaaaaccatgtataatcttccttcgtcagttcccgtaaataaaaatacatatccggaggatgtaacacttcgatatcctcttctcttaccagcatgtcccgcatcctatccatgacatgctcttcacgcagatgaatatagtaacacagatctcccatatcacttccctgcccatatgctgaaatattctccttatatcccaggtcttccgcaccgatatatacatctccttccttcataaaagaccgcgcgatctccttaagtttctcttcataaaccggagaatatatcatggttaatcttgttcttgcagtctctcttccctcctctctcccttccactctttcttcttctcttctgtcttctctactagctagatcttccatctcatctgaaacccggctcagtctgtctaacagtttcttcggattatgatacttgcaaaaggtgccttcctcttcctgtgcagtcagcaagatcagccgcttctctcttagcaaaacattctgcttctccttggaaagcctctgaaaaaaagcttcatctaaaagataaatgtctgcccgctccttaaaagctaaaaaactttctgttgttgtaaaatgatatacccgtatcgcagtagaaaggtgtgtctccagatatctcaccaatcttctcccatattccccttcctctccgatcataatcatatgaatatctgaaaaacgcatactataacacctcccacattcctatgtgttcttccagaagctctctgctctccatttatattatgtaaatatataacagttattccaaaatcaatatatcacatcgcaagtattttgtctacctgttttttactatttttactttttttattttattttccaccaacttcatttatcctctctcatattttccgctttttcttcatacaatctaaaaacaacctttttggaggtatactatgtcccagaatcaaattcttctcatcttttgtgtcgcctgctttgccggttattttatcgcatacataaaaaaaagaccgtcagcgcttctcttcgttatcggtagaagcactgctggccttggattcatttacttttttaactttttttgtgccgcaagagacatcgttaccggcgtaggaattaatcccataaccggtaccgtctgtaccttgtttggaattcccggcgcaattcttctatatgctgtacggctctatagcttcctgtaaacctattgcagtaagccactcaatgctgcaaaaatagacgataataccgtctttattttggcaaagataccctgggcatcaatatccatttcactgagtttatcgtaaatcttgcttgcctgttcttttaagtcatttacatttaaatcaagcttattaatcttctgcatcaattcagcaatctgttcacgctgatcatctgtaatgtttacatcaagatctttactacattcatcaataattgtattaatatcctcttttgtttttgcatcatcagaaagaaccttttctttaattaatgctaaaaactgctctgctttctcagaatcattcaactggtctgccagcttacttgtaacgactagctcattcgttgctgcatctttactctcacttgaaatattctctcctgtcatatcttcatatgcattcatcgcaccaaccaatgctgccgtacctgtaatattaaatggtccggctacggttacattcgcatcggtcactccggctgttgttaatgcattctcatacattcctgcggtacagtacgtaatgttctttgttgtaacatcaattccctcgcccttatctcttttctctataagaacagaagataaggcatgcgtaccgattacagaagaatccagataatcatccagatacttatgctcatctttatttgtaaccttcactactttatactggtccagctcattttcttttactccaagaagttcgagtactttactcttctgactggcactaagatctgcgcccaatgacaaatatggtttctcttctaccgcatctgcggatacatttgcctgaaatgtcataagtcctgctatcataatcgctgataaagcaactagtttctttttaaacataattaagcctcctttttatatcaatgtactctcagagtcttctcacaagatgaagtatcaaaagttccgagagtgcatatcctgtacattcaaaatcttctcacaaaatcacttgcatgaagctgacgaagcttccgagaatgtattatcttacaaagaatcaggaaaatagctgctgataaaacagttatcttccatccgacggtaaatcccggcggagtatattttaaagatactttatgttttccggaataaatatttactccaagaaaagcatctccaatcttatgtgtttttgcttcctttccatctatggtaaccttccatcctttgtcatatggaatagagaaaaataaagtctgatcctgcgcagcattgacacttccctctatcaatcggtctgaataacgatctacagaaaatgctcttgttgcagcaatctttttcagattactgtatgcctgttgatcaaaatcagccgctgaaagtcttacatatccatcttctgtctccccttttaattcaaaggttactttcacctcggaacctgcggctgctttaccaatcggaagcatatagccatcaatatctccggactttacattcaccccgtctacgttgatctgtgcattctctacctgcgtaccatcatagaaaagatatagattctctatatctttcgttattggaatcgtaaatgtcatgttatccggacgggaatccttatattcaaagtagtactctccatcatttgtccttgatgctgtacagccattcgtttccgggtctgaaatcctgatattatggaacaactctgatactccaaatgcctgctcaccgagatcattttgtacccggaaaggataggcactgtcataataccagtcttttacagaacgattcatgagatatccaatggacattccctttgccggattctcataaatatcaaaagaaccttctgactttacatattgaaaatctgtctgcaggctgtcttcctgatggtaatacaggtattttacattcaaaaggaagttcgttaccggtgtcgctcctttataaagatactcattacatccggtgtaaaatcccagattatccattatagttaccatgcggtctgtcgctgtagaaccgaacagccccacactgtttatcggataccatgcattctcatctaccataagcgcactggcaagctcacttctgtaaaaggttccatcctttaatgattccgttgctttttccatatcttctgttccatagaaaaactttgaaacagaaatctgtccgttctcattaaatcccataaaagcagttactgtaatttcaatcactgccactacacagaaaataaacttgtatatatactttcttttacgtgacagcgtatagaagaataacaacattccataaaggagtaagagcattcctgccacaccatagacattatcttctaatacctgcgttccttttagctttgcataagccatcagtgcaactcccgccatgcaggcaaatgcggcatgccagccttttactccttctaaatgctcaaatacttcccatagcatatacagaagaacaaaaccgaataagaaagaaaaacgattcggtattccatactgatcatgaaaaccatgccagataaaattgagaatcatttcactgaagctcagataaaaaagaccgattaataatacttttttaatcttttcactgactttaatctctccgtttaatacatacagcccaaccgcaagaacggaaaaaattccaatatacagattggcattcccatcaaagttgtcatggctgatcggactccacaaagcaaactgccgattaagcaagtccgctgcactagtcaggaagctatgttccggaagctgcattgtctcccctgatgcggtctgtttgattcccatataagcaggtatgagtaaaatagctgccatgcctgccgccagaaaagaataaaatgcaaaagctatccctcggaagaaaaactgttttatacttttaaaagaatagagaagataccatatcactgcaaaaatacagatcataaaggcgatataataattacagtacagcgcataaaacagtgcgatgcaatacagtcttccatcctttttttctatgagccgctccaatcccatcatgatgatcgggaatatcattatggcatccagccacattacattccagcaatagccaaccatatagcttgaaagagcatataccatcgaaatcatcactgtggaaaatccctgctttttactctttgaagaaaaataaataccagcagtcattccgctgcatgcgatcttcaaaacaatgatcatactcactgccatatttaattgacttttcttaaaaaataaaatcaataagttaaatggactggacaaatagtaggaaaataacgacaaaaaattaattcccagtccggaacggaaactgtaaaaaagggtttccccaccttttaatttatcatacaacacagaataaaacggcatatactggtgaagcccgtcaatgatcaacagcgaattatctccaaatggctgtacaccaaatacaatacaacagcctgccataacaagaagcggaaggaaaaaagaaagagctatcagatgctttctctgcagcttctgttctatcttgcacatatttttacctatattcttacctgtcgtttgttcttctttcttcttcaacatcttctatccattcaccttctctatctcttcaccagcctctttcacacgccttttcaaaagccccagacatcgcacgatatctattctcttctttatcataaaactcatacttccatgggtcatctgtgttacattcgaagaatgtcttcgataatcgatcaacggttcctttataaaacagacctcacccatatactccgcagcagttccgatccaataatcatgcatgtacatttcttttggtatcggacagattacaggaatcagctccctacgaaatgccatgcagcatccgacataactgttctttacaagattcttgagtattcccttcctgcttcctctgttcgcaaaaaggccttctgcaccagttggatttccgcactcatccacaatctgcgcatcatgaagaactgccttcacctttggattcaaaaaagcttcatttaccttctttaccttatctggcttccatatatcgtcctgatcagataaataaataatctctccactgcaatgacgaatcgcattctcaaagttctttacaacgcccttgcccggtccctttataacatgaatccgcttgtcctcttctgccatcttaaggagcaaaggctttgaaccatcacttgctccatcaacagatacgataacttcatcctgttcaccaagctgtgtcaaaatcgtatccatctgttcttctatatacatcccaccattataatatgccattgccactgaaatcttcataaaaatctcctacaaaataatatcgtcttcctgctttttcttctctgctgccagaatacgctttttttcttcttctgacaagtccttgtctttcaggattttagcatagttttttgtacttcttgttaaattattccccaaaaaaattttttctacctgcccatccatttttccaattacaacacccatgatatctcctcctgttttcgagttttcgagctattttgaacactttaaaaattgattttttcctattttctcattattctcattctttagtatctatatttttcgatgtgtttcaccttttgttcaaattttcgtcaaaaaacggacatattttttctttatagtatagacagcaacaaagaaatccctctatttcttgtggctaaagatttttttcatattttgaagcccgtatagaagaattatatgggcttcctccttttaatgaatgcctctaagaggcacaaaaagaaccctttccccgagggttctttttttgtctatttgtatttatttatcagcctttccggctatgtagttaatgaactgctgtgcagtacgtccggaaattcctccatgagaaagttcccacttgtttgcttccgcacataattccttgtcgctcattgtaatttccggatatttctttgccaaattggttacaatctggaaatactcctgctgtgttggcttggagtaattgatacttacaccaaaacgtgctgctaaagacagcttttcctgtactgtatcggagcgatgcagttcttcgtccttatcagaacgatctgaccatgtctcacgaatcagatggcggcggttcgatgttgcatagattaaaacattatccggttttgtttccattccaccctcgataacagccttcagatatttgtattcaatctcaaattcctcgaaggaaagatcatccatgtaaataataaatcgataatttcgattcttgatatggctgatgatcgcagaaagatatttaaactgatgtttataaatttcgatcatacgaaggccatcaccataatactggtttaagattgccttgatacttgtagacttaccggttccggcatcaccgtaaagcaaacagttatttgctacttttccctgaacaaaagcttctgtattatctaccagcttcttcttctgaatctcatatcctgtcagatcatctaatacaaccttatctaaattgttaattggaacaaagtctggctttccgttattctctacaatacggaacgctttgttaagaccaaacattcctactccataatctttataaaacttcacaactgcatcaaaaaaactatccacatcttctgctgccgcaagttcatctgacaatgcacgcaccttttcacttacgttcttattatacatacgctctgtcttgccgattgccttatagtctaagatcgtacggaaacaatcgattcccagtgtctcctcgattgctctgaaatcatagtgaaacaggttcataaatacctgaaaatcattctttgcaaaatgatttactgtcccgttattcgcccctactttttcactcgtcatactaaaagaattctcattcgtcacaagtacaaatgtaagataattatgccataagtttttatcaaaaccgtatgtcgttgccagatcaagcaatgccttcatctctttataaatatcagtaatcagctcatctgctctgtaatggcagctgtcaaatctcttaaaaatatctgcgagatttaaaagaatactgtcttctcctaaatcacgatataaaatcaactttgatacttctctgtacattttctattcctcctgattctcagaacagtttttcaagatctcatctacatttaatgcatcgatctgagaagcgaactgactctttaactgttctatcttatctttcgcctgttcacgatttccatcaaatgacgtgtatcctttaaaagatgctaccattggtttatcttcatccgatgcatcccccttagaatacaactccagaccaggaaatgcaaactttggtttatcttcatcgtgaacattaccattcttaaggtcttctaaggttaccagaccaggaaatgcatgttccggccggtaatctggcatcttaaatacatcaaaacattctaaaatatccacatctgtcatatcatctggcaaatcttcttttaaatactccggatggtactgcttataaaattcataaataacctgctttaccttcgggtcacgaatatctgtctctaccctctcatcattaataaacagataatatctgtctacatacggcaaaatacgttcttctgcagtaatagatgtcacttccggtacgctgtcataagagacttccagccggtgaaatgttctctgtccttcctgtgtctgtgtaacaccctcgattttatatttatctaactcaaaaaacatactttttaataacgtaaattcatacataaattcattctcccaatactttattgtgtttttaaaatctcttccatctcatcaagcagttcaccaaacagctttaatgcagattctactggctctttcgttgccatatcaacatcacaaagacgcagcaggtcgatcggattcatggaacttccaccactcaggaacttaaaatatccttctttcgccttttcatccccacttaaaatctttctactaatagcaatcgctgcagaataacctgtcgcatactgatatacataaaatggtgtatagaaatgtgggattctcgcccattctaatgcgatttctttatcaataacaataccttctccaaaatactgctgattcagcttataataaatgtcacataatacttctgccgtaagtggttcctttttcgccgccatctcatgtgtaatcttctcaaactccgcaaacatagtctgacggtacagtgttcctttaaactgttctaagaaatagttgatcagatacattttttcttttgtatcttccgtattctttaataaatattccattagcagagcctcattacatgtcgaagctacttctgcaacaaaaatacgatatcctgcataaatatatggctgattcttatctgaataataagagtgcatcgaatgtcccatctcgtgcgctaacgtaaatacattatttaaattgtcctgataattcatcagcacaaacggatggcatccatacgctccccaggaatatgcaccgctacgctttccttcattctcatatacatcaatccagccattctccattccatcggagagaaccttcccgtatgcttctcctaatggtgcaagccccttttttacgatttcttttgcttgtgcaaacgggactttcatctcaaactcttcaaccatcggtgcatacagatcatacatgtgaagctctggcacttttaatgcctttttgcgaagtgcaacataacgatacatgagatccatatgctcatgtactgtatcgatcaggtttgtatacacagataccggaatctctcctccatctaatgccatctctaaagaggaattataatgtcttctctttgcaaaaaacgctgtattcttgagattagccgcataaagtgccgctaatgtattcctgtattgtccatactgtgagtaaaccgactcaaatgcattttttcgaatatttacatctctgttctctaaaagaagagtatatcttccatgacttaccggtatcttctcgccttcttttccctcgattgacgggaatcgaatatctgcattattaaacatagaaaaaatattcgacacatcggcagacatatcggatacatccgcaagaatcgcctcttcttctttggaaagaacatgctccttctggcggaataattcataaaaatatcttctgtataattccatatccggattctgtgaaaaccacagttctatcgtgtcctcgcctattgctaaaagttccggctcttcaaatacaactgcactgtcaagctgtaaagataatgcctgcgcctttcctgcaagcccctgataaaaactattccccgtatcttcatgatatcgctgattggcataaacatatatggcttcaaacttcttcatgacttcttcttttttacgcatatactctacaaaaacttcagaaccttctttcagtcttccttcatatgccgcaagttcctttgcctgctctgaaagcgcttcataatccttttcccatacctcatctgatgcatataaatcctgaatatgccactggtatgccggatcactttccgctctttttttaaccgttctttctgtttctctttctgccattttatctgtgcctcctgtctcttttatgtactctcggaatctttttgtgcttgatttcgtgagaagattttttgtcagttgtgcctaaatttttgaggcgtacgcggtgcgtacgttgatgaaattcgggtgcgactggcggaaaatcagccacaaaaacaagtgcaagaaagactccgagagtacatttttatgcctctaagaatctttttgctgcttatttcgctgaaattattttatcccatcgggcatatactgtaatattcttttcattcccctttggaattactttaatctgatttccttctttatcataccatcctcggaaataatatcctctccttgtcggttcttttaataaaatatcacttttaccagaagcccgcaccttatttttcggggaattcactcccgcattccgatacgtaatagtatatcccgaaacctttactttaaacctctggcgctttccgttaattcttacagaaatgtacgtttctccagcctttctcgctatcatatatccggtattattgatacttacaaccgaagagttcccgcttgtccagccggaagttcttgctgcccggtcatgcatatggcttggtgtcatctgtctcacctgtccagcctgcatagaaaggcgcttctttcctcgttttgtaagctctcctgttcttatccgctttccaagataaactttcgaatatccctttcgcactccatgaaaatccgagatataataagaaagatatccccgtttatttaccgtaaaacgtccaatatatataagcttccataacggatctgaaacttccgaactttcttccctctcatctacttttctcagcaaaacaggatttctcttaacaaatcccatcttgtagatacctgaattcattgagaatataatgtaatgattatacggttcgatccatccaatatatctgcctccggaaggactgtataccgtttttgttttctttccctgaagagtagaacacttcaaagaattatcctgagaaatccagtaccagaaaccttttctgtaaaatgtacatgttcttgccttcagtgcattctttatttctttattatcttttatataatccgaattagaaatcggaattccccgcatattcaaatcattcgaattaccctgaccatataaatctttcgccttgtatcccggatgtgtctttaaaaaccctttctttccaacaagaaaactttcataactaaccacagcaccttcatgctttcccgttccaactccattcgtcaaatctacatagtaccactttccattcaactttataacgttccaggaatggttcttcgaatagttacttacgaccgcacatggaattccaagcgtgttcattgcaagagcatacgcattcgcaagaccatcacaaaccccgatgtgcttcaccagaacatcatatcccgtatgtgcatctgcagattctctgtatatggtattctttgcaaaatacgtatataccgccatcgccttatccgcctgcgtcatagaagattctacagactctaacgcttcatccagacctttgatgatctttttatatcgtctttgaaactttgtcctgctgataagcttcgtgctgttaaataccgttgcattcccttctttttctaccgcataatactgggaccagtttgaatcaaggaaatctattcgttccgccataatcgccgccctgttattaatcgctgccgcccgaaggcatgcccttcctgaagaaccctgactgaccgaaccgtaaacatccatattctgtgtcaccgttccttccatcatcagctttgacagtacgttaatatattctctttgtgtattcgaaaatgacgccgcattcacatcctttgtaaaaaaaacgctccctgctaaaataacgcataataaaatcaaaatatgacctgctctttgcagacgtttactcaaccctctctgttcatccacatgtatacctcctctcaaatagataaccagtacatttgttttgtgctctactatctatcttatcatcatatattaaaaatagcaattattgtcgaaacatgatagaatataaatattatgccacaggcacgataaacaggaggaacatttcatggctaaaaccgctgaattccatactttactccgcaattaccgcggaattatgggcaatatacgtatcaataacctctggatttcttttgattcctgcttctttaattattatgcagatgacgatgagattcagtttaatcttgcaggacaggagggagttgtcacgattccatctgtcatttcctacgataaagttgatgaagaagacttgtttgaagatgctgtagccggctataccgcaacattagaatctggtgatatcattacattttactgtttcaatgcaaaaaataaatagtaaaaaacttaccacctatagatgtagattttatcgactgatattaacaaaattaactggcattgacaaaatcattagaaaaaaagaaaaccattatgactcacgatgaatcataatggttttatgctgcggataacaagacttgaacttgcatgagcgtaatgctcactagaacctgaatctagcgcgtctgccaattccgccatatccgcttacgaatattaattttatcataaataaaagatgaatgcaagcattttttacaagaatccggggctgtttggggacagcccctcatctcacttatttctgataaattatgatactgtctttgaaagttcattttccggaattaatccaatggataataatacagtatcacaaggaatgatctcttctgttccaagaattggttttaaattctcatctactgcagatacttctaccgcctgtactcgtttagagcctacaatcttcgttacggttgtacttaaatgcctccgagttcatcatttctttctaatacagcaaccttttctgctttttctcttgcctttaatgctgccgcaagtcctgcccggctttgtacgatttctaattttattctgctttctgaatctttgtatcttttaataatgctgtcatcagattggtatacagtaattctgaacggatttcttcttccggcattgtatctaaaacatcttttttgtccttgtagcctaattcgtcaatataatactgtatctctttattcaattcttcatctgttaccgttacattctttgcttctactaacaagtcctgcacgcactgtctcttaagcgaatctttggcatattcttcgattgacatatcgttatactgctcaataaagtcacttacgctcatgccaaagtactctgccatttctttattctctattttaacatttttcacttcctgcttaactgcatcttccgggaacgctttaatctgcgttacattctccataatctttgtccagagcgcatcttcattattctgctgtgcttctgtcttcttatcggaaataagatcttttctgacctgttgtttatattcctttaatgtagaacagtctgtattctttttaatgaaggagtctgtgatttccggaacaacttctttttctattgcattaatcgtcactgtcatctgacacttctttcccgctacagaagtatcttcatagctttccggaaatgtaaattcaacctctatttcctgtccaaccttacttcctacaagcttctcgtctatatcgacatcatcatctacattcaggtttccttcccctaaatgaatgtcaatactgctgtcagaataatcttcattctccttaccatcaatcgttgttgcataatcgatattcagataatcttctttctgaacagtatcacgactggtaatctccttgtaatctgtatattcgtcagccagttcatcaatcttatcttctatctcctgttctgtgaccttcgttgaagaacctttaatcgtaagtccttcatattgcccaagcttcacatattcagaagcgttcagttctaccggtgttgtctgctctgttgtagaagctacttctgttgtcgcttccgcagccttttctccggactttgaggtagcacatccacccaccatacacatagatgctaacaatgccgtcgcaataaatatctttctctttatcataaattataaattctccttttttattgtcagtttacccgtcacctgctttattctactttaccattaatcccactctattctcaatcattttcacaaaatctacatatattcttttacgattttggcacttctgtatctgctaaggcaggcatacagttcctgctttcttggaagaacgggatgtccggcagaatagtttgcaggaattaccgctgccattccttttctctcgataagcttatacatattttctatgaattcctgaatatcttcctcttttgttacatgatctagtatccaccccatcatataggcaagtgctgttgtctgtccactttctgaaagctgttctaaataacgcacatcaatggattccctgtcgatcagcaccgtatctgttcccattgattttaactttcttctagcggattttaccggttttaatttacgggaaaattccggcacacaaacttctttttccgcatactgccctgcaatctggcattgttcgcagatttcctttgcttcttttgtaacatcttttactttataatgatctagctgaagcacaaggtctgctacggataaataatctccagaacttcctacaacaatgataaaagaaattcccatcgttttataaattccacgtatgtggcgaagtaaggttgtaatcggttctttttcatcagaaaccaactttgccatcactttatcccgaatcataaaattcgttgcagaggtgtcttcatctaagaacagcaattctgctccagcttccatggcttctatcagattggccgcctgagaagtacttccgcttgcattttccgaagaaaaatctacggtatcctgtccagcaggaagatgattaataaacagagaaatatctgtatgcaaaatacttctgccgtcttctgcccggattttcattcctgtagcatctgctacgacatattctctcccatctcctgcaatatgattatatactccctgttctaacgcttttaataatgtagactttccatgataaccgccacctacgataacagtaattcctttaggaatccccattccgatcatctttcctttatgcggaagctctatttcaatctgtaaggattccggtgaaataaatggcactgcatcccgcattggacgatcggaaatgccgctttctcttggtaatattgcaccgtttgccacaaaacctgtcaatcctctttcttttagctgccagcgtaattcctt

SEQ ID NO: 428 - DNA, 31568 bp, Eubacterium hallii
atgttgggatttcagcatcgattgggttaggaaaagcatccaccattacggaatcaactggaagaagtaacttcttaccaagcttttctgctttttccatcatttctttacagtaatcaatctttgtctcatccactaaagaatgaccgatttcgtatccttttgcttttaagaatgtgtaagccataccaccaccaatgatgagtgtatcacacttctcaagtaagttagaaataacatttaacttatcagcaacttttgcaccaccaaggatagcaacgaaaggacgtaccggattctctactgcattacctaagaagtcgatctctttctgcattaagtatccaactactgctgtgtctactaaagaagcaacacctacgttagagcagtgagctctgtgcgctgttccgaatgcatcgtttacgaatacatcacagatagaagcaagatctttggagaattcttccccacactttgtctcttctttgcggaaacgagtgttctcaagcaaaataacatctccgtctttcatagcttctactgctgctcttgcatttggtccaactacttcacgatcagcagcaaactttacttcctgtccaagaagttcagataaacgagctgctactggagctaaagtctttgttgtgtaatcttcttctgtttttactttacctaagtgagagcaaagaatcactttaccgccgtctgcaattaacttcttaattgttggaagtgcagctacaagacggttctcgtctgtaatctttccatcctttaaaggaacattaaagtcacatctgcaaagaactctgagtccttttacattaatatcatctacagattttttatttaaacccatgttggaaatcctcctaaattatattcatgtactcttaaaatcaaaatctacataactgcagatttatcagacttccaaaagcactttttcaaaaacaaacaaaggtccggtcccacgagaccggacccatgtttgagtcttatattcttaaatatatactaatactatcgcttagattatgctaattcagcaaagtatttgattgtacgaaccatctgagatgtgtagctgttttcgttatcgtaccatgaaacaacctgtacttcgtataaatcatcagcaactttgttaaccattgtctgagttgcatcgaataaagaaccaaatctcattcctacgatatcagaagaaacgatttcgtcttcgttgtaaccgaaagattcgttagctgctgctttcatagctgcattgattccttcaactgttacatcagcacctttaacaactgctgttaagattgttgtagatcctgtaggtgtaggaacacgctgagcagatccgattaacttaccgtttaattctgggataacaagaccgattgccttagcagcacctgtgctgttaggaacgatgttaactgctgctgcacgagatcttcttaaatcacctttacgctgtggtccgtcaagagtcatctggtcacctgtgtaagcatggattgtacacatgataccactctggattgcagcatatttgttaagagcgtcagccataggagctaaacagtttgttgtacaagatgcagcagagataatcttatcttctggttttaatactgtatggttagtattgtaaacaactgttggaaggtcgtttccagcaggagcggaaataacaactttcttagcaccagcattgatatgagcctgagctttctctttgcttgtgtagaaaccagaacactctaatactacatcaacaccgatttctccccatgggcaattgtttgcatctgggaaagcgtagattttgatttcctttccatcaactgtgatagaatcttcgccagcttttactgtagctgctttctcatatgttccctgagaagagtcatattttaataagtgagcaagcattttagggcttgttaaatcattgatagctactacttcatagccttctgcaccaaacatctgtctgaaagctaaacgaccgatacggccaaatccattaattgcaacttttactgccatggtaattcctcctaagttttagatattctttgacattaaagttcgcagggaatatgccctcctgcgttccgatttgactcatcctgtcaaatccttaactattttacctaattattgccaagatttcaagtagtattttgcataaaattatagatttttttctttcacttttatgctattatgatattgttgccatttttcctgcaagtatacagagtttttggtcttgaaatacaattttttacctttatttttgatacgcaagaaaattcatatacaattttttacccgaaaggaatgatgattatgatttacaccgacacacatttacacacatctttttcttctgattcagacacgcctatggaacttatgatcaaaaaaggacttgaacttggaatgaaaacattatgcttcactgaacactatgatccctgctatccggatacacctgataagctggactttcttttagattttgaaaattataaaaaaacactattttctctcaaagaaaagtatgcctctcagattgagattttatacggacttgaacttggcgtacagccacaccttggtcggttacttgctaacttttatgaaaaatatggaaaagactttgactttattattaattcctgtcatatcgtaaataatatggatccttattacggcacatatttcaaagagcttggcgcaaccagagggcttatgacttactttgaaacagttttatccaacttaaaagcatttcctcactaccagtctgtcggtcatcttgattatgtgtgccgctaccttccggaatcctcccagactttcttctatgatcatttttctgatattctcgatgaaattttaatcgaaattattgagagaaatcgcgctcttgaagtaaatactgccggactgaagtacggacttgactggccaaaccctgacatttccatattaagaagataccgcgaacttggcggcgaacttatcacgatcggaagcgatgcccataaaccggagcatatggcatgggagtttgacaaggtgccggatattcttcatagagcgggattccgccattacgtggtgtttaaagagaagaaaccggtggtttatgatatttaatggactaaagaaacgaaaagcagaaatttgatatagaataaaatgtgaagatagtcgcgacgtagaaaatgcctgaccggcatttttacttgctccgacatcacattttattctatatcaaatttctgcttttctgttctttggcgccagatgaaatcaggattttgtgtagaaaaaataatctactgtcgtgtttctgtatgactttggtaaaattattgtaaaaaaagaaaagagaggcaaacatactcagagtaaaaaatgtcctaaaacaaatccagcatattatcaagatatattgcttctctgatatgtatctgatattccttcttgaccatataataaagcaaaaattccagcaccaatgcactgccaagtccccgtccttctattttaaaattagaaaatcccatcggcagataaacattttgaatatcttctgtactgataaatcccggatttttcatggcttttgaaaaacgatacccttcttctgcatctggtgcagcacaatgatgttccgggcagttctctccaagattttttcgacttactgtttcataacaacgctttctgtccttacatccaaaccaacagcattcattacataggaattccactttatctttttctatttgcgttaacgtatttaacctatcaaaagacttgttcagacgaaaatctgggacaacgtattgaaaatcttctctttttacttcttttaaaaagtcctgaaaatttatcaggacttttgttgttgaggagacaaagtaaaggttagaatagttcttttttaagtaatccaataacaagtctgcatgaacgataactccattttgtattgctttaggctgtacattattctcttgtatatcttttatgcttttattttgcatattggagtctgataccctttctctttgtatatccccagcttcttcaaataacttgcacagtgcattgcattttttatccaaaatatgttcttctctaagcagcgaattactaaaagtcagccgggcagaaattccatactctttcattaaatctaacactttccttgcatcatcatccccaaatcctgctcgtcctccgccccagatacaatccgccggggcaccatagacagatccaatatcacaccaatcataaaaatattctcgatgttcccgaaataacggcaaaaacactttatacaattcataaaactcaaacagtcccggaagatgatactgtgctatacttcttttcacttgtagtgcctccttattctatccgaagcatccggtatccgattccgatatgcgtctgtatatactggagtccatttttatctggttcaagttttttacgtaatgttgccataaacactcttaatgaagcaacatcattttgtgaacagcttccccagatctgctgtgtgatataggtatgcgttaaaacccttccgacattacgtgacaaaagacataaaagcttatattcaattggtgtcagatgcagttcttttcctttcagataggtacagccagctatataatctatttttaattgtccgttaataaaaatagaagcttcctgttcttctcccgcctgaataatggcaaggcgccgctgtgtcacccgtatgcgggcaagcagttcttccaccgaaaaaggttttgtaatataatcatctgccccggaatctaatgcttctattttatcgccatcttcacttcgagcgctgataacaataatcggcatattggaccatgtacggatttttttaattacatctactccttccatatccggaagacccagatctaagaggacaatatctggatgatgtgaagatgcttccattatcgcagatactccattgttagccgtaagatatttataatcatgcatttttaatgttgttacgatgagatttcgtatcggacggtcatcctccacaacaagaactactgttttattcatttaatgtcacctcgctaagtggtaaagtaaaagtaaaaatacatcctcgtggtgtattatctgtaagaaggagccttccatcatgtgcttctataatagactggcaaagtgacagaccaagaccgagacttctctggctgtctgcaatcgtacttttcccagtataaaacatctcaaagatatatggcttcatttcatctgcaatacccggtccatcatcctccacacagatctgtgcttttccattacatttcattccccggatacagattttcgaacctttcggtgtatattttatagcattatcaatcagattcactagtacctgtataataagctgcacatccatacggacaagaatcagttcttcacactttgtcacaattgtatattcatcatgcttcctgctgatatgacgcagagattctgcaatgacttcatcaagtaactgatctgtaaatttaaacttcagccgcccatcattaagccttgtaatagataacagattctctaccacgccaatgagccattcagaatcatcataaatatccgcataaatctgctgcttcgttttactgtctaagcacgctccgttatttaaaagcatatccgcattgccggaaatagaacaaagcggcgttcttagatcatgagaaatcgcacgcagtaaatctgctcgcagctgttcatttttcgccaaaacagcattcttctctttttctattgcattgcgcagattttccatagcaagcgcacattcatttactacggaaagtaaaatgctatactcaacggaatcaagaacatctttgttcgctgggattccaattacaccatatacgtgatcaccaatgcggatcgctaaatataaacattttgcatttttaaaataattcgttcctactcctgcacgcttattattttcatagacccatctggcaatcttttgttcttccggtattaaaaattgctgattcgtttcttccttattttgataaaacacctgtccctgtgacaattttccctcttctacaatatatgcaacaatatcccggttcagtaaacgaaccagctgcgtgcaggtgacacgcaacatctctttactgctcctcgctttttgcaacaggcggtctgtatcgaataatacctgcgttcgaaatgcaagctgagaggaaatccttgcatgcatttttaatttagcggaaagagttcccgccaacacagagcataccagcataatcgcaaaagtcaccggatatccaactgcatatgtctggaaagacatccttggttccgtaagaaaaaaacaaaataaaacaacgcttaaaaaggaacctgcgatactgcacagataaccgtctgtcaaaatagaagtaatcaatacaccaagaatatatatcgtaacgatattcgtatctgtaaaatgcagtttctgaaataaaagaccaataatagtacatatcataaatataaaaaccgtcacaaaacaatctttcattgacggtttctttgcatataatgcaaaatgctgctttaatacgccttctcttctttcattttcttccattatttcaatttcccgccttttatttgaattcaagagtatattagagtatatcacactgctttatcaccgtcaaaacactgccttttatcttccttttttgaatcataaattatcatacttgctttaccacatttcttttgataatcatgtatttcttttaacaactcttcatcagaaattttatccaaagatataaatttacaggattgcgtattttccctctcacctataataaatgctttgtaattttcattgatgaaatatccaatctttcccataacaaaaaaacaaacaataaacattaccaatactgttaagagtaaaattacttctttcatcatttatcccctctttaatttaaatatggaaacactttttaattgccttatgctctccgattactaaaagagtgatatcccctgtaaaaaatgtatctggagatattgccatgctaagctctccattattttttattgcaaggatattaatatcatattttcttcgaatatccagctctccaaccgtttttccaatccactctttcggtacttccacttcaaatattgcatgagaagcatctacttccatataatcaaggatatggtcatcggtataacggattgaagcccattttgccacctgtttttctggataaattactttatctgcaccatttcttaaaaggaacttctcctgaacatccctctctgctctcgaaataaccatttttgcaccaagttcctttaataaagatgtggtctctaatgaattttgaaagcttcctccaatcgtaacaaaacagatatcataatttccaattcctaatgattctaaaaattccgcattcgtgctatctccaatctgggcatttgtaacgtagggaaggactttatctactctgccctcattgacatctactgccataatttcatgccctaactcactaagctccattgcaatatgtcttccaaatctcccaagtccgattaataatatatttttcatcatttgattctccctctgtgttatctaacggatgtcatacacgatcctaacacttatcctactgttattttttctaacggtaaccttgcatttcccttctttttctttgaaaggaccgcataaataagagtaagtcctcctactcttccaagatacataagtatgatcagtatgaattgtgacactatatgaagctttggtgtgattcctaatgtaagccctactgttccaaccgctgatgctgcttcataaagacactctaaaagcggaagcccctcatatacactgatcgtaattcctccacataaaaataacatacagtacatcatagcaatcgttgatgcattctttatcacgctgcattcgattcttcttccaaatgtttcgacattttcctgactccggaatgtagcaaatgcattcaatataagtactgcaaaagttgttgtcttcatacctcctgccgtagaacttggcgaacctccgacaagcataagtataataatcattgcttttgaaacttctgtcattttagaaatatccatagtattaaatccggcagttcttggagttactgcctgaaaagccgatgcaagcaaccgttttcccactgacagatgagtaaaatcagaaaaaaagaaaaaaacagctggtaaaactatcaaaagtgcggttgtcacaagtataatcttactctgcatatgatactttctaaagtggattttattaatacaaatatcctcccacgtaagaaatcctataccacctgctataattaaaaacataatcactacatttacaatcggatttcctgcataagccgtaatggatggaaatggattcgtgggcgtacctaaaatatcaaatccagcattacaaaaagctgatatggaatgaaacactgccatccatatcccttttcttccaaaatcatgataaaaaaccggcagcaacgctaatgcgcctgccatctcaataaataatgccccctttaaaataaactttgtcagacggacaattcctcctactttatgtgcagaaattgcattctgcatcgtgctgcgctgcatcagagaaatctttctgcctgacagcataaatacagaaacggcaacagtaactacaccaagtcctcctatctgtatcaaaagtaaaataactacctgcccaaaaacagaccagtaacttcctgtatccaagacagcaagtcccgttacacatactgcggaagttgatgtaaaaagcgtctgattaaatggagtcatcactccctcggcagaagaaactggcagcattaatataattgcccctaataaaataacacctgcaaatcccagaataattaattgaaaagaagacaaatgcttctttttatgtatgtcccttgacataaatccctcctgttattactatttcatccggcatgtttccctcattatatatgtccgcattcaaagatagtgtaaatatatcgactaccatattaagattacataaagatttatagattgattttgtatagacgaaaaaagaaaaaatgccctatcccatcttctctgtagtcgcatctgggatagggcattttttcttttttctgactattcaaattcgcgggaatggggattctcgcgaaggttgtggatttccatgggattaaattctaaagagttgacattcaaattgttgtatgttgctgaattgcattgaggtttctaaagaaaagcgaattcttataagtttgattttgttccattacgctaaacgcttcatttttcctcaaaaaaccagcggctttctaaccacatcccacaactcagttaaaaaacaaggggattgtccaaaagtctacgatttctaatataactaaattccatgtatatacaacaacttaaatgtcagctcttttgaatttaatttctcgaaaagtcataatctactggaaaatccccattctcaccaactgtagatttagattaaacagaaaaaagaaagaataccatatcccagatgcggcttcggagcgtgtttaagatgcagatgagcatcttaaatacagcgactacagagcagacgggatatggtattctttcttttttcgtctacacgaaatctgcaaatcaggttttaaagttttcttctttttatcacaataccgattccgattgcaagtattatcagtggaatcacaaatactgtcataatcaatgttgctttctggttaaatgccggtacgactgcattctctgtttttaagctcttcgctctaatcgatatcttactcttttgttctgcaagataattcacaccatttaatacaaagtccgtattggctccacttactgcctgatcaatatcctgaagtagcatgttcgtacatccagttacaatcattcttccaccagaagaatcagataccgctacagagatgtcaaatggaccgctgatatctttcttttccttatttaacgtggaacttgatgtatctaccttggaataagcgccatcacttgtggaaagtaatgaagttacagtataatcggatgcagaagaagctttctttgcattcttttctgtgatatcttttaaaccttttgcacttggagcaaggacataaacattgctgttatactgtgcagaagttgcatcagaactttcaatcgtcggcagcagataaattggatattgtgtatatttacttgcatcgctttctaccacaacacctttctgcggttctacattatatgattgaagcaggctgtataagtttgtaagattctctactctcgcatctaagaatacatacatctttccaccgtttttcatataagttttaatcatcttaagctcatcttttgtgatatctttttgcgcaccattgatgagcaggatcgaacaatcatccggcactttctgttctgtgagaagattcagtgtttttacagagtaattgtccccctcaaaactacttgtcgtacttgaatcaaaactttgttccgaatgtccgcttaacgtatagattaccggtgtggaatctgaaataacataattaatcgcttctgttgtaagactttctaactgaagagaatctgccgaataggagtaatcacttccataactgtaggaaacataatcatttgcagaaacatagcggtatttcttaccacattttataatcatactgtcatttgcaacttcttcactgctatctacatatttctttgtaaagtttggatacagctctggatctttataaacaaattttatttttgcagaatttttcttatattctttccagacctgtgcataagaagaatttacatcagattctttattcactacatatatggtaacttctttatctaacccttttattatttttttcgtctgttttgaaagtgagtaaattttattggctgttacatctactgtatagtttttacttgttacaaatatattgaccgcaataactgctgcgattaaaacaacaactgctactgctgaaaaaatacctttttttaattttgtattcatctttttccctgccattttatgccctcctaattccatctgcgtttttcaattccctgcattgtcaggaataaaaatactgcaataaatgatacgtaatatacaatagaagatgcatttaaaattccactgcaaaagtcattaaaacgatctaatacagaaaaccagtcaataattttagacagaccgttatcaaacagcgcaggttttactttgcttaaaacaccaatcacagcgataccggcaatgcccactcctgttgcaattttcatgttctttgtctcgtcatagaagaaccatgcaacaagaagtactgccagcacacatacgagatacgtatatcttgctcttcctggtacaacatttgagatattcggaagtaacatacaaaataaaactactgcaaaggataaggctgctgcgatcatctgattatctgtgatagaagatacaaacattcctactgccatcaggcaggcgcctaaaagaaagtaaccaaggcagccggtaagaactgttttccaacttacacttccaaacatacttaatacaccggcttctataaggcttactaacatagacatagcaagcagtgttacagatgccagatactttccaaggacaatgcttcccggtcgaattggggaagtatacaaaagctggtctgttctctgcttcttttcttccgcaaataaacgcatggtaagaattggcacaataacaatatataagattgtactgttagaaaatacatactgtgaatagtctgtatacccgtaagacatacagattactgaaaaataaactcctgttgcagcaataaaaagagcaaaataaatataggctgccagtgagtggaaatagcttctcatttcttttaaataaatggctttcattctacttatcctcctcttttacgtcttctgcttttttctttcttttaaaagaaaaaccatgatggctttgcttttcaatctgctccgaagccttctttgcctctgactctacttcttccacatcctgtccggtaagtttcaggaatacatcttcaagagataaactttctcgttccatcttgatgatcggcaatttttcttctgcaaactcaaagaataaattatcgcggatatcctcttttgttgctgtttttgcctgcacatcaacaatgtcttctttttctcctgtaatcttgtaatctttaatatattctgaagcttttaatactttttctactttttccttatctccttttaccgataagataatactgtccgtatctgaaaaatcttctgataaatgctctggtgtgtcttctgcaactaatgttcccttatctataataagtacataatcacatactgcattcacttctgataaaatatgagaacttaaaataatcgtgtgcttttcacccagactcttaatcaaagaacgaatctctataatctggtttggatcaagacctaccgtcggctcatcaaggatcaatagtggtggatttccaattagtgcctgcgcaagccctactctttgtttatatcccttggaaagatttttaatcagtctttttttcatatcagaaatctttactgcttctgttacttcattgatcgatgattctttttctgtttttttacggattcccttaagatcacaaataaaattcaaatattcttctactgtcatatcttcatacagaggaggaatctccggaagatacccaattaacttctttgcctgtaagggctgttctaaaatatcatatccaccaattttcacttcaccagaagtcgcagaaatatatccggtcattatattcattgttgtagactttcctgcaccgtttggtccaagcagaccgacaatctgtccgtcaggtacggaaaaactaatatcttttactgcatggtgttttccgtaatctttgactaagttttttacttctatcataaaataagcctcctgtttaaatttacacgtagtatagtattcttaatttacgataattttgtgaacatatgccttttttcacattaagttcacattttaaacagaattatccttatgtcttttattgtttttctattaacaatgactcttttatatatatctatatgattccctttttctttttttattttttatagttttctttttttgcaaactgaaaaaatgaaattcttgcagctacaactatcattttttctcattttgcacttaaaaatatgaagttaaatgtcgggttatgaaatttttttaaaaaaaattgtacttttgcttattctttttattgaataacttctcacaatatagtataatagagcgcggaaaaagaacttgatgagagacttgattctgatatttttttgtcaatcatcaggagtttaaaaatatgtataatatacaatatcaaggaggaacaaactatgtcttacgttgatgacgtacttgcaagagttattgagaaaaacccaagtgaaccagaattccatcaggcagttactgaagtatttgaaacaatccgcccattaattgaagcgaatgaagaagaattcaaaaaacaggctgttttagagagaatcactgagcctgaaagaatgattaagttccgcgtaccatgggttgatgacaatggacaggttcaggttaacatgggtatccgtgttcagtttaacagcgcaatcggaccttacaagggaggcttacgtttccacccatctgtaaaccagggtattatcaagttcttaggatttgaacaggttttcaaaaactctcttacaggacttccaatcggtggcggtaaaggtggttctgatttcgatcctaagggtaaatccgatcgtgaaattatggcattctgccagagctttatgacagagctttgcaaacatatcggtgcagacactgacgtacctgctggtgatatcggtgttggcggaagagaaatcggttaccttttcggacagtataagagaatcaaaggtctttacgaaggtgttcttacaggaaaaggcttaacatatggtggttcccttgcaagaacagaagctacaggatatggtcttgtatactttacagaagaaatgttaaaatgccacaacgatgacattgctggtaagacagttgttgtttccggtgctggtaacgttgcaatctatgctattgaaaaatgtcagcagcttggcgcaaaagttgtaacttgttctgattctaccggatgggtatatgatccagaaggaatcgatttagctgcattaaaagaaatcaaagaagtcaaacgtgctcgtttaacagaatacaaaaagtatcgtccaaacagtgaatatcacgaaggacgtggtgtatggtctgttaaatgtgatattgctcttccatgtgctactcagaacgagcttttccttgaagatgcaaaacagttagttgctaacggatgtatcgctgtatgtgaaggtgctaacatgcctactacattagatgctacaaagtacttacaggaaaacggtgtatggttcgctcctggtaaagcttctaatgccggtggtgttgctacatctgctcttgaaatgtcccagaacagcgaaagattaagctggacattcgaagaagttgacaacaagcttaaaaacatcatggttaacatttatcataacattgatgatgctgcaaaacgttacaacaaagaaggcgactatgtaactggcgctaacatcgctggtttcgagaaagtattaaatgctatgcttgcacagggtgtttgctaattcttccctgattattatttgaaaataaattttttcttgaaatcgtttttcaaatgatatataatcaaagaacacaaaggagtgttccgtttaggaatactccttttttgttttcctttttttcattttaaggtttatgaaagaatcctagagtacattaaatcacttttggaggtaacatattatggataaaatagacagaaaaattctctctcttcttcaggagaatgccagatatcctttaaaatatcttgcgcagaaagtatttttatcttctcctgctgtttctacaagaatagaacgtttggaaaaagccggcattctcaccggctatcatgcaacgattgatcccgttgctcttggatatcatattactgcatttatcaatctgactttagacccaaaacaaaaggatgagttctatccttatgtcaaagattgtccaaatgtacttgaatgcaactgtgttactggtacatattcaatcatgttaaaggtagcctttccaagtacaatggaattagacacctttatcggacatctgcaaagatttgggaacacacagacacagattgtattctctactgctgttcccccaagaggagttggcatcgaaacagatgaccttgaaaaagaataattaccggatactctataatttctctgtcaatactgtctagagatattatagagtatccggtaattcgttttacttatgataaggatggttgttgagtattcggtatcctcgatagatctgctcatacaaaaccatacctgtcatattagaagacatggtaaagtctgagagaatcagagattctatcattattggctgttttgtttttgatgccatctttgtctggttatcagccaaaatttcttcgctccattccggaaccaaaaacataattccctttattccggaaccttcccaattttttatctgttcacttagtttttctgatgtaagttccgccttgcctggctgtactatgaacttcttcatccctgtatcttttactaacaaagactcccattctttttctttctttataaacttacaactaatcttacaatagcggctaagacgtttctcatattctgcgattgctttcttacagaatttctgtgacttcttagattcctgtatatatatttcgtatttcatgttattcctctattaaaatgcataaaaaaaacgaaccagaagggactcgaacccccgacacacggttccggaaaccgttgctctatccaactgagctactggtccaatggaagttcataaaaacttccgctgtttataatactatattttatatcatattgcaaggaaaattttctttgtaaattcgataatcctctgcattttctctcagtttttttactgcttctttgatacattttatcgtgtaatcgatttcatcctgcgtgttttgatagccaatcgtaagtcgcaatgttccccgagccagtttttccggaatccccatggcggtaagcacatgagaaggagcagtatttcccgtactgcatgctgaagcagcagaagcgcatatatttttatcatctaacaagagcaataattcatttccttctataaactgaaaactgacattgcaatttcccggcagcctcctcgcaacacttccgtttattcgacaatatggtatttcttcacaaagttttttcataagataatccctcatttgctgcactcttttctctctttccttctgtgcggcaaatgcgatctctgctgcctttcccataccaacaattcccgcaacattttctgttcctgcccgatgatttctctcctgctttcctccatgaatataagacataacaggcacacgcttatctatataaagaaatcccaccccttttggtccgttaaatttatgtgcgcttgcacttagtaaatgtatattttctcttttaacatcaatgggaatctgtccatatgcctgtacggcatctgtatgaaagaaaatatcattttcctttgcaatttttccaatctgcccgattggctgtattgttcctacttcattattagcgtacataatagaaattaatatcgtatcttttcgtatcgctctttgaagcgcatcgaaacgaacacacccccactcatctacatcaagatatgtcacttcaaatccctgtgtttctaaataagcacagctgtttaatactgcatgatgctcaattttacttgtaataatatgttttcctttttcttttaatctttgtgctgtactttttatcgcccagttatctgactccgtcccacctgatgtaaaataaatttcttctgcggatactttcagcgtcttcccaatttgtttgcggaccgtttctagcgcctgccgacattctgatgccattttatatattccagaaggattcccgtatttttcgcaaaaatatggctgcatcacttcttctacttccggacgaaccggtgttgttgctgcattatcaagataaatctgctgcatagactttcctcttttccatcattctttacgaattgcttctgaatagatacttttatttctgcatacaatcaaataaccctttatctatggtgttttcatgtcatataaaacttcctataaaaaaacaatttttactggaacattaattttaacactctctggttttctcgctagaatactcggattctataacagaatattcctttctaatctgattggtgcaaaagaacttggaatttatcagctgatttttccagtatatatgctatgtttttctttatgctgtcatggctttgagactggaatctctaattttacttctcgtttttttgcaaaagggcaaaagaggaacgcacaccggcttgtaaaacttggctgccttctctctttttttctttctattatattaatgttttttttatttgaagatgctgattatttaagtacatttatcttaaaagaagcttctgctgctccttctttaaaaatcgcagcactctctcttccctttgtgtccataaaagcctgtctccatggctattacatcggtttgaaccgctctgctgtacccgcagtcagtcagattgtggagcagatcacccgcgttggaagtatttattttctttctgttaccatttttattttaggtgccgatgctcgtattgcagcctggggaatggtgcttggagaaggagtttctacattttatactattcttgcctattttcgtacatactttttagaaaacagaaattccctttttcataagaaagcaatcttcaaaaagaaaaatacaaaaaaaagagcagatactcatcgaagcgagcctgctcttattccggcaaaaaaacttttctttcactttttttcttttagtctccctatctccatcaatcatttcagcctcactgtaatcagcagcttagaaacgatgttaattccttttatgttgaacatatttttccaaagtcatactcatgctttagaaacttatggtactttaaccggcatggcattaccgtttctattctttcccgctacaattataaactctttatccgtaatgcttataccggctatctcttctgcctatgaccgaaaacagcaccagcaaatggagaaaacgatttctgccagcctgcacttttgtattctcatcggtatattcagcacgtttgcctttcttatttacggaaccatactcggagaaaccatctttcacagtaaggaagccggagaatatgttcattctttctctcttctttgtccatttatgtatgctgcacaaacaacatccagtattctaaacggatttggtaagacaaaacagacactctaccacaatcttctcggtgttggaatccgaatcttctttattctgctccttattccttccaaaggaattttcggatatttattaggacttcttgccggatacagccttcagcttcttttaaatatttattatatttatcgcacgatacctttttccttttgtgtccaaaagacgattctttatcctgtgattactgcgataatctgcggaattctttcaaaaaaatgcttggaaatcgctacggtttctctgcagattcctgcattttatattctcgctgccagcggatgcctgtattttttcctttttatccttctgcagcttttaagggagtatgtcactacacaactcgggcaatctgctcacataaaataaggcgcatcatctgatgcggaaaagtaagcgccgaaaaacttaacttttcatttgcccttcgtatcactttctccgacagaccaagcgaaccaccaatcacaaaagtcacctgtgaaggtacctgcaaaaaaatcctgttcatccggtcgccccattcctgtgtactataatgctttccatcaatacaaagagcaacaacatattcatcgtcttttattttatttaaaatccgttccccctctgtgtctcgaatctgtctttccacagattcgggacacgaatcaggtgtcggttcatctggacattccaaaatatccatcggatatttctttcggatttcttttacataatgtccaataccctctttaaaaaattcttcttttactctgccaacacagacaatctttattcctttcataatacattaatcgtctcttctatcaccgaataatagaagaagacgtaacaactgtaaaatagaagatgcagcagcagcaacataagtaagtgcagcagccgtaagcacctttcttgcaccagaaatttcatcgtcataaagaatatgagaattaccaagaatctttaatgctctcgaagaagcattaaactccaccggtagcgtaacaagctgaaatattacagtaagggaaaacagcaatacaccaagcatgatcaatgtatggcttcctccaagaataattccgatcaaaataagcggccaggaaatacttgctccaaaattcacaactggtacaatcgcaccgcggatcttaagaggcgcataactttctgcatcctgaatcgcatgcccacattcatgtgccgccactccgatcgccgccacagaagtagagcggaatgttgcgtcagataaattaagaacccgacttcttggatcatagttatctgtcagatctccggaaatatgccgaatctccacatcataaattcccgctccatgtaaaatacgctctgccgcctctgcagcagtaattcccgcatgacttcttaccttatcaaacttcgcataagtagactttactcttgcagaagcaagcagacagattatcatgcctattacaaccagaatatatgtcgggtcccaaaatgccccgtaatatcctccataatacatatcgatacctccaatcttaaatgtaagcaattctttcttctcttacttccgaagttcttcattgctcttaaattattataaatccttttcttttcattattgttcaatacggtaggcagcgataacctccgctgtatacatatgatgataatccttctgtggataccatcttccatccacttctggatcaataaattcttctggattcaactgcgtttccataagttttttacatacaaaaaccattttaccttcctcaaaagtcggctgttcctcatcggtttttactacatgaaaacctactttgctaattttatcttcatctcttccagatactttcccaagatatcccatctcctccttacgctctccatcaaaaaatgttaacgtgaagaattcgcctgcatctacaaattcttttgtaaagcgctgtggacgtatcccaacagttacgacattctttccccaaaaaacacccatcattccccaggaagcagtcatcgtattcaccttgccttctctctcggcagaaattaacatccagtcctgaccaattctctgaaatgggtttatattttcctttgttatatcaatcttttcaaacttcattatgatatcctccttaacatttcaattaataatccagctttcttgccgcttctacaatcatctcttcagttacagtatatggataatgcgcaagatcctcatcttttaccataaacgatgcgcactttgcgacttcttctaccgtaacaccaatttcagaaagtttcgttggaagtccgactgtcttattaaaagcagtcagcttctcgcactcttctgctttaccatcaatcgtaagcagaagcaaaacaccaaatccaacgacaacgccatgcagatgattctcatcaaatccaggcagattgcaaaggccatagaaaaaggcatgcgcagctccaccattataatccatcgtatgttctcttgccacaagtaacgaagcccagcctgctgtaataataatagcaagtgctgcctgctctagcgcataggatgctgttccctgctcgttatcttttaatgcctgtgctccatgttcgagcattgcttccatacacatacggctaagctgtactcccattgccttataatgctctaactgctcacctcttgcagaaatacttacttcataatactttgcataagtatctccaattccagcccataaatattctgttggcgcattcgcaataatttctgtatcaataaaaatatgcttcgccggctcgagaaaatgtacaaacttgcaaaatgttccgtcttcgttatatacaatagacaccgcagatgtcggggcacagtttgatgcgatcgtcgggaaagaaaaatacggcttttcaagtgcaatacttacaagcttacacgtatcgattgcctttcctccgccaacagcaaatatcacatctgcctgttgcactgcttctaactgttcaagaacttctgcattctcaaaggtacattctcctccaaaccatacaaaatcaacaatttcaattccagtaccttctaccgcacaaagcagcttctccttcgcagcagccatcgccttctttccaccaataacaactgccttgcttccatatatgtgacattgtttttcaatctttttatatgcttccggtcctaccgtatacggtggaacctgtactgaatagttctccatgatatactcctttctgtccgttttattatagtaaagtaacatcgccccgtcaatatacgattcctgttcttgttctttcccatctcatatgctacactcatagagactatctacttaatcaaaatatataaaataaaaaaggagtgtttcattttatgttaaacaaacaatacacaaacatgctacaggaaaaagacgttatctttgaaatattccagtatgctacagaacgtgccaaagtcgttggagcagaaaatatttatgattttagccttggtaacccttctgtacctgcaccttctattgtaaacgaaacaattgtccaaaaagtgaaaactttagaccctcttgccctgcatggatatagtccaagctttggaatcatggaaacccgcgaaaaaattgctgcctctttaaataaaaaatatggttcagcctacaaagctgccaatatttttatggcaattggtgctgctggagctttagctcacgctcttcgtgcggtaacaaatcccggcgatgaaattattacttttgcaccttgtttctctgaatataaaccatataccgccggcgctggattaaagcttacaattatccctgcagatatcgacactttccagattaattttgcagcatttgaagcccaattaaatgaaaatgtttctgctgtcctgatcaactctccaaataacccttccggaattgtctactctacagaaaccattgaaaaactgtcatcaatcttaacagcaaaatcaaaagaattccatcatccaatctatcttatttcagatgagccttatcgtgatattatttttgaaggagtagatgctccttacattgcaaattattataagaacacgctaacctgctattcttttagtaaatcgatctctcttccgggagaacgtatcggctatcttgccgtacatccggattgttctgatgccgataagattattgaaatctgtccgcagatttcccgaacaatcggtcaaaatggtgccgcttccctgatgcagagaaccgtagcggatgtctgcggctgtacctccgatttaagcgtgtatgaaacaaataaaaaaatactttttgaagcgcttagagaatacggctaccattgtgtagaacccggcggaacgttctatatgttcccacgttctttagaaccggattcccaggcattttgcaaaaaagcaatggaaaaagatctgatgctcgttcctggagatatctttggatgtccggggcacttccgtatcgcctactgtgtccctacgcaaagagtggaaaaggcacttcccgtatttaaggaacttgccgaagaatacagataacaactatagataactcacaaaaaatcaagaatatcccgtactgttatgtagcaaatcacagtgcgggatatttcttttctattttataacaatttaattctttaaagattctttttccagaaattctataaattcatcttccggcaatggtctggaataataatatccctgaatataatcacaaccgctttgttttaaaaatcttacctgttcttctgtttctactccttctgcaactgtctctatatccatctcatgcgccattcctataatattacgcacgatacttttcgtttttggattctcttccatcttacggataaagctcatatcaatttttaatatatcaaaatcgtaatcctggagcatgccaaaggaagaaaagccacttccaaaatcatctaagagaatcttggtatttctaatccgaaaactctcaagaatatcactccgattttccctgatggcagcgtatgaagtttctgtaatttcaaaacgagtcatatactctctgcccacttctttaaattgatctatttcttttatgattgtttccatcatcgcttcatcatagaaatccatccaggataaatttacagataccggaacaacaaacttattcttttcgtatctttcattaatgaactgccacactttcttaagtacataaaaatcaagctcggaaatatgaccatcctcttctattgccgggataaataatcccggggaaatgaatcccttttctggatgaatccaacgaatcaatgcttctgctgaagcaatctttccagttttcgcatcaataactggctgataataaaccttaaactgttcctgtgcgattccctcctgcaattctccggtaagctttgctttgtctacataagccgcctgcatagaatcatcataaatcatgtatggttgaacatattcatccgtaatatacttcttcgcaagctttgctctgtcgatcataccagaaatcttcatcggttcatcttctacataaaaaataccacatcggataatcaaattcatcctcttaccgtctttgcaaaacttattctcacatacttttgtcagttcttcaaagtctaaattcttcttatcaatcaggcagacaaaatgatcagactctactcttgcaacgatcatcggagccagtcttgaatatttcagcgttttatatatattctgaagaactgcatctccattctccactccaaacaattcattcactgctttaaaattctttatattaaaaaacaatactgcatactgtgttctatcagatactgcatttaaaaaacgttctgtgttgcgaataaatccccgacgattatatcctcctaccaaaacatctttttctgaaaattcagtaatatcctctctcgccccgacaataatatttaatcgtttatctacataaatataagaatatctttttaacctcacttcacctgtttcatctatctcatgaacagtaaaagaatactgtttatctttgcaaagaccttcttctattgcagaaagttccacacattttttaaacttctcacactcactgtccacaacgtctttctgcgaatcataagaagtccagccttcatataattcttctcttttcaggtactctgataaaacagaagataaaatgtctgtctttatcatcttttttctatttgcatcaataatgataatattctcataattcttctgataaatcttttgcggtacattctctacaagataccctgcagtaatatctgtaaaatgtaacactgctccaatttcctttgaaaaagaattccttgccatatctacattcacccgcagtacagatacctgtgcttcttttgaacaggcaaatgccgtatccatggaaatgtctgtttttccttcatgaaatgtctttaacatatttttttgtgaaaacttctgacaaaaattctttcttaattcatctaccggaatcattttactgatcatctctatataagagtcaatactctgaccttcccgaccttctaattcctccttctttccggcaaaagaaagacagattccctgggaaacattcgctgatacaatgcctacagagtctaatgtatgactcattgccatctgcaaaagctttatataatcatcattaatatcccgcacatacatgacaacctgctgattatcctctctgtactctgtgcttcgtacaatctccatggaaatccagcgatattctccatcaataactctacgatactgtaaacttgcatattggctgccatctgaaaaaattctcttcaaatgttctatagaacaaaattctacatattctttataatcctcctcatgaatatacccttcttcagcaagccccataagacattcggatatactttctttttgaaaacactcccttagcggatcattgtctccatgctctataatctcataagtatctgcctttaaatctatttttaaaatccggaaaaatattgtagacaacatcattaccgcatcattaaaattgcttgaaatgttatcatagagagtaatagtattccgaactcttctagatacaatagattcattaaatggacgtacaaaataatcgctagctcccaattcgtaagccttcctcacgctctctccaccaatctcagcagaaataacaattacaggaagcctgtctaaccactttctccttttcataatggaaagggcttcatatccatccattaccggcatattcatatcaagtaatactagcttaaactcttccctgcttttctctaatatatcgattgcttttttcccattctcaacctgataaatctcatactcatcctccagcatacttgcgagaagttccctattcagttcagaatcatctactatcagtatttttaatttgtctgtattctttccggcatctagcatcttcatctccctctcttctcacattatgctgttataaagcacaacaatataatgtcagtatatcatctatacaacaaaaattaaagatttttattaaaaagagggaattttttactctcaattccctctctcattttatattttacaatatttttctatattcagttgatataattaatcctcaaaatatctctcgaggaactgtctcgttctttcttccttcggatgttcaaatacctgttccggtgttccgtattctgcaatagtaccctgatctaagaaaaggactttatcagatacatcacgagcaaacttcatctcatgcgtaacgataaccattgttgtatgtctgtctgccagaccacgaataacctttaatacctcaccggtaagttctgggtcaagcgctgatgtcggctcgtcaaaacacaggatatccggctgtaacattaatgctcttgcgatagctactcgctgctgctgtcctccggaaagctgatgtgggtaaaaatccatcttctcttttaatccaacactttcaagaagagcctctccctctgcctgaatctccgcaagaatctgttttttattctctttaaaatccggacgttcctttgccattaattctctggctaatgtacagttacgtaacgctgtatattgtgggaaaagattaaaggactgaaataccattccaaaatgtaaacggttctttcttatctgtgcatctcccagagacttattatcatctgcatcaaagattactttatcatttacaataatctgtccatgtgttggacgctctaaaaagttcaggcagcgtaaaagcgttgtctttccacttcccgatgctccaatcattgcaagggcttctcccttttccagagaaaaatcaatgccctttaacacttcaagacttccaaaattcttttttaaatttttcacttcaagaatagacatcaaaacccctccttatactctaaaatagtccattttcttttcaatccatccaaataaaagagtgaggataccattgaaaacaaggaaaaatactgctgtagagaataatggccagatcaagccctgttttgtaaaacgttctgcgcacatgataatctctgcaagaccaataattcgggcaagcgcggtatctttcgtaagagtgattacttcattactcatcggcggaataattctctttataacctgtaacagaataatcttaaagaaaatctgtgtctttgtcataccaagaacctgtcctgcttcgtactgccctcttgatacactttcaattccaccacgataaatttctgaaaaataagcagcataattaataacaaatgcaataattgctgctgtaaaacgagaactcatcggcatagaaaacaaaagtcctggtgcatacagtacaacgaacaactgaagcatcagtggtgttcctctgataatccagacaaaagttctgcttaaccattttaaaggcttaaactttgacatagagcaaaatgtaatcactaatccaagtggcaatgccaaaagtaaagtgataaaaaacagctcgatgttaataatgaatcctgaacttaaggattccattgggctggtagccatcataatcttatccttctttcttcatatattttgaataattttaagaatacctcagcattcttactgcgagatgcccggctgaaaccacaacaagaatccggtctttctgtcccttttcctgtaaaagatactgaaatcccggattcttttatatgtattcatacggagcttatacagcttctatatcataccatagaaacagttatttaatcaacatatcctgtaaatcgtatttcttagcaatcgtatctaccgttccatcttcataaagttctttgattgcctgatttaccttttctgtcacatcgctgcccttacggaatgcgataccatattcctgctgaccaaagttattatccatgttgataactaaatcttcataatctgttccttcgccaaccataccaagagcacatacactgtcaactaaagcaacatctgctgttcctgattttacttccatgagagccttagccatagaatcagaagctacatagttcgcatctttaaagtaatccttagcagaaacctttactgtatcatcatcggcaatagaaccgtcaatcttaccttcaccagtagaaccctgttctgctgtaacagtaagaccttttacactcttcatgatttctttttctctgctcttcttcattaccatagcctgtgtattgtaaagatatggatcagaaacactcatattctgctttctctcttcggtaatacacattccattccaaagacaatcaatattcttagagtttaactctacctctttagaatcccagttaatttcactaaattctacatcaatgccaagcttctttgccaccgcctgtgccatctctgtatcaaaaccaacaagctcattcttttcattataataattcatcggtgcaaataatgtaataccaactgtaagcttgccctttccctgaatataagcccaatcagaatcagaacttgtacttgtagaaccagcttcgctgccactcttattagaagaaccacatccaactaatcctgtaacgctcattacgagaactaaaagcatagcaattatctttttcatagtatctctcctttttctttcccttataatctctgcgtagttttatcaatgcactacactaaagtattatagctaaaagggagttatttgtcaagatacaaaaaaaacaagcctgatttgatggactaaagaaacgaaaagcagaaactttatatagaataaaatgtgaagatagtcgcggcatagaaaatgcctaaccggcatttttatttgctccgacatcacattttattctatataaagtttctgcttttctgttctttggcgccagatgaaatcaggattttgtgtggagaaaataagggggttgtccagaaatctacgatttttatttgggtaaaatttccagaataaatgtgtcaatcctttagactttaattttctggaaagtcatatccttctggtacattccacattgtccaactgtagatttagatagtcagaaaaaagaaaaaacaccctatcccagatgcgccttcggagcgtgtttaagatgcggataagcattttaaacacagcgactacagagcagatgggatagggtgttttttcttttttcgtctattaccaaatctacaaatcagtaattaatatcttggggttaatcctacatacatatctttgtactgttttgcactcttttcccaggatacatctttattcatatcacgaatcaccatatcatcccagcattttctattctcgaaataaagagttttagctctgttgatcgcatcgtaaagaaggccactttcatatctgtcaaatgtaaaaccattgcctgtattttcaaatacattgtaaggctgaacagtatccttgagacctcctgtttctctgacaatcggaactgcaccatatctcatagatataagctgggtaagtccacatggttcaaaccttgatggaactaaaagtgcatcgcatcctgcataaatgttatgagccacattttcattgtaggcaatatacgcacaaaaactgcctttgtatttattttcatagtagcggaatgtgtcctcatactgagaatcacctgtaccaagaacaactacctgtgtatttccatccatgatacctggaattacgtcattcactaaatcaagccctttctggtttgtaagacgggaaatcagtccaattaccatcttattctcatctacatctaagcctaacgcttcctgaagtgcctttttgttcacttttttattctttatcactgattctgcatcataattagatgccaacagcttatcggttgccggattccagatatctgtatcaataccattcacaattcctaaaattttattttggtgatatcttaaatgttctgccagtccttcaccatactcctctgtctgaatctcctcagcataggtattacttacggttgtaactttgttacagtaatcgattccaccctttaacatatttgcatcaagccagttctgtgtcaggcaatccttattaaatacataatcaggaagtcctgaccaatattgaatcatttttctatcataaatgccctgaaatctcagattatgtatagtaagtactgcaatcgcacgtcccacatctgtatcactaaagctggttcttaagtaaagaggtactaaagctgcctgccagtcatgacaatgcactacgtccggagtccaatccagataattgagcgcagcaagcgaagcttttgcaaaataacagaacttcggtatatcatctatcaggtttgtatatggatcgccccaggagaaaaactcatcattatctataaaatcatagacaacaccatcttcctgatactccatgattcctacataatattgttttccatcggagcagagattcatatagaaggagcccctgtattccatcttttcctgatactcctgaggaatacacttatatcttggcagaatcaccttaacatccaggtttaattttgccagagcctttggaagagcagacattacatctccgagtccaccagtcttaacaaatggataacattctgaaccaataaaagcaacacttcttcttggtcctaaatccggctgttccatcggaatattctgttcaactgtcgtcttcagagttgctgctttttcctctatttcagctattttttcttttgtttcatctgctttttcctttgttgcagccttagaacgaaccgttttctttttggtcgtagtttttggttccgctactttttcctcagtcacagtctttgaacgaactgcccttttccttgtcactgttttagacttagctacctttttcttcgactcttctttcggcttatctgcctttttctttggctcttctttcagcttatctgcctttccctttggctcttctttcggctcatctgcctttttcttttcctctgctttcggcttatctgcctttttcttttcctctgctttcggcttatctgcctttttcttttcctctgctttcggcttatctgcctttttcttttcctctgctttcggcttatctgcctttttcttttcctctgct

SEQ ID NO: 429 - DNA, 31384 bp, Eubacterium hallii
cattggtatttgaaacgaaagggaaatttagatggccaaaagaaactcttttaaaaaagggacaatagaattattgacattagctattttgcaagatggggattgctatggatatcagattacacagagtatatgcgataaatccaatggcattattacagttacagaaggagcgttgtatccaatattatatcgattagtggataagggatatttaacagactataaaaagccggcaggcaaacggttaatgcgggtctattatcatttagaggaagctggagtaatatattttcacgagctgctagaagagtataaccaagtaaaattaggtgttgaattaattttatctgagaaccattcttaatcagaaatagtaacgagaggagaaaatattgaacaaaaaaattgaaggacattatatcaagaaggttcgacagagcctgccagtatatggtcataaagaaaaagcctatataaaaaaattagaggagcatttgcaaaattattgtgatgaatatccggatgttacggaagaagatattgtaaaaaaatttggaacaccaacatctgttgtgtctgagtattttgatgaaatagatgaagactatttgtttcgaaagctaaagatacgaaataatataagaatatctatttctgtaattacagtatgtataattattttaaatattttttgtggttatctttattataaagaatatcaggcaactagaaattcaaatattactaaagaagaaacaatcactatcataaaagaggagaggtaaaatgttgaagaaattttttaaaaaattaagtattatatgtgttattattatggtattgcctgtcaatacgtttgctacaaatattgatatggctccggatatagaatatttagaggatggattttattatgaaaccacattagaagagttacctgtcttttcaagaaatgcacatacaaaaactgttcaaaaaactacaaattataaaaatgcagagggaaatgttatgtggagtctgactttaaaagcaacatttacatacaataattctagtgcaaaatgtacctatgtgacaggaaatgcccaaagtgttaattcacactggaaagttagttccaaatcatttcagaaaagtggctcgacagcaacaggaagcgcaacggtaaaacagttaatgaatggtaaagttatcaaaacaacaacaaaaaagatttcaattcattgtagtccgacgggaaaaatctcataatggaaccaaattatgaagtgtggatactgtaaagatgaagggattattccgacgcttgcaatagaatggtatccggaaaatggaagaattaaataaaaaattgttaattaaatttattgccgtagagaaccgtaaaaagttgaagtagtctaaataatatgattttgccattcgagagagaatcttcggcatctacctacatctgcaaatttccattaagatataattttgcatattcaagaggttcatcaatggcgagtgcgtttaatgcacagtctgatcctggtgtggtttttaaattcttttcagcttcccaacagtcaatgcagagcatatagccaacagaggtgtaaacatcaatactgttgcgcttgggattgtattctgcaaatattgttctcatcgtatcaaatctccttatcgttaaatcaatcatttgttgcaaaaatcagaagcatttcaatcagttcaccatgtcacttttattttgtgttatactgttttatataattttcttgctcttgtttttgcccttatcagagttcgtaaacactggtgggacgatataacgcaagggaaacaataagggaaagctcacatgcgataaactttgtgttttcaagggattgagagatatttgataataaaatataacagttattaaatcctttggaatatatgaaatctcaattcaagtttgtagaggacttaatgaatccttgtaatattgggcgttgcatgaatgttaatttgcgttgcttgatgtattgagggctaatcagtatactagttttatcaaacgaaaggagtagctagagatgattggtaaaacgatactttacactggtaggtgcagaaaaaatgcgacagtatcggagagttttgattgccaggaagaagaaaggatagatttattgccggaagtcacagataaaaggtggcttccggctttttttcatgccctatatttattatcaataaagttatcaatgttttgtaacttaggatatgatatgtatgtaatgaaaatattaattacaaatagtaattcgttttatatcataaaaatttagcacttttatgagaaaaatatgttaagaagtatgggatatttgtggataaaagaacatacgtatggtatactaaatcaataatattgttattttaaggagggggatagatttggataagatatatgctgcaatcgacttaaaatcattttatgcatcagtggaatgtgtggaaagaggcttagatcctctcacaacgaatcttgttgttgccgataagagccgtactgaaaagaccatatgtcttgccgtttctccttctttaaaaaaatatggtattccaggacgtcctcgcttatttgaagtaatacagaaagtgaagaggattaataaggaaagacaggaatctgctccggggcataaatttataggacaatcctttcattcagataaattaagtgatccttcggttgcactggcatatattacagcacctccgagaatgtcattgtatatgaaatatagtacacaaatatatcagatctaccttcggtattttgctccagaagatattcatgtatattcgattgatgaggtttttattgatttgacaggatatttgacaaattatcggatgggggcaaaagaattaatttccaaagtgatacaggatgtattaaaagaaacagggatcacagctactgcagggattggtacgaatctatatcttgcaaagattgcaatggacattatggcaaagcatgtgccggtagacgagtatggggtgaggattgcttatctggatgagttaacatatcgaaagaaattatgggaacatcagccgattacagatttctggagagtagggaaaggttatgccaaaaagcttgctgcatatcagatttacacgatgggagacgttgccagatgctctgttggcaaagaaaaggaatatcataatgaggaattactttataaactatttgggattaatgccgagttattgattgaccatgcatggggatatgaaccttgtacgattgcagatataaaagtatataaaccagaagcaaaaagtatcggttccggacaggtattatcttctgcttattcatcagaaaaagcaaagattgtagttttagaaatggcggaacagattgcatttgatctttttgaacagaagcttgtttcaaagcaatttgtcctcacaataggctatgatagggataatctacaagtacagaaatacagtggagaggttgcaacagaccgttatggacgaaaaatccccaaacacgcacatggtacgattaatctggatacaccgacttcttcactaaaagaaattacaactgctgtttctagtctttacgacaggataattgataaggaactccttatccggcggctcacattaactgctactaaagttatgcccaaagaaggacaggtatatcagcagttagatctgtttactgattatgaagcattaaagaaagaacaggaaaaagaacgtagattacaaaaatctattcttgatattaagaaaaaatacggaaaaaatgcagttttgcgagggttaagttacgaagaaggtgcaacaacaagaacaagaaatggacagataggagggcataaagcataatgggaaagtatgacgatattatcaatcttccacatcacgtatcaaaaaaacactcccagatgcttattgcagacagagcagcccagtttgctccatttgcagctttaactggatatggagaacagattaaagaaactgctagaactacggaagaatttcatcaggtatcaggacaagaaaaagaagagctaaatcagaaattacagatattactgcaaacccaatataaacatcctctgatttctacatattattttacaccagatgcccgaaaacaaggcggacattatgaaaagaaaacggaatatgtgaagcgaatagatcctgtaaaagaatatattattatgaaagatgatacaataattcgatttcattatataaaggaattacaaggagagatttttaataaagttctaagtttttagataattatagaagaaatactttcattttccttaaggtaagatttggcaatataaaaagattcggaatttttgattttgaaatatgcagattcataaacaatcctcttatttctttattatactatacaataacataaaacaacatggaagaaaacaaagagttgacataaaaaatacaggttttatgcaacctacttttttaatataactgtcaaattcccgattattttttattataagataaattttacagacaatatagaaataataccatttatttatagaaatattacagattttattgtgaatcatgaaaagacaaaaattagtgttatatttccctattttatgaaaggattatccaagagtgaatggagttggtttgctataatgagaataattattgatattgtagaaaactgtgctggaatgttttttaacatactctggagcaggagtactgcgaattgggataattgcgatgaataggaaaacttgttaggaaaatttcatgaaagaatgaaagggaaatcaggaggaggttatataatgtcagataagatttgcagcagtgcggataaggtgctggaggtatttttagagaatgcaccgatggatacttcacatcatcgtatggtgaagcagcagaataagtgtggatatggattacagggagtatgttgtagattatgttcgaatggtccatgtcgtttatcaccggcaaaaccaaaaggtgtatgtggagcagatgcagatacaattgcctgtaggaattttttaagacaggtggctgccggttcaggatgttatacgcatgttgttgaaaataccgcaagaagattaaaagagatggcacaggaattacaggcggaaggcaagaaaccaaaatataaggattccgttgcgaagcttgcaaagattttacagatcaactgttgtgggaactgtgggtcggactgccataacagttgtgcgaagacggcagagatgattgctgatgcagttcttgcagatattagaaagccatatgatgaaaaaatgactctcatgaaaaatattgcccttccgaagcgttatgaattgtgggagaagcttggtattttgccgggtggagcaaaagacgagatttttaatgcggttgtaaagacatcgacaaacttgaattcagatccgatggatatgctgttacagtgcttacgtttaggtatttccacaggtaattatggactgattcttacaaacttgatgaatgatattattatgggaccaccgcaaatcagtatggatccggtaggttttcgtattattgatccggaatatataaatattatgattacaggacatcagcagtccatgtttgcagacttagaagaaaaattagaatcagaaattgtacaaaagtctgccgagcttgttggtgcaaagggaatccgtattgtaggctgtacttgtgtggggcaggattaccaggcacgttccggctgctataaagatgtatactgcggacatgcaggtaataactatacaagtgaagcggtattaatgactggctgtgtggatttggttgtttctgaatttaactgtacgattccgggaatcgagccaatttgtgaacagttagatattaagatgctttgtcttgatgatgtggcaaagaaggctaatgcgcagttattgccatacacagcagaggaaaaagaaaagattacaagtcagattatcgcagatgctctatgtgggtttaagaacagaaaagaaaaattatatggaacagctccggccaaaggagagaagcgtgtcaatgtcatggcacagcatggttttgacaagtccattaccggtttatcagaagatactttagtagctgctttaggtggtactttacagccactcattgatgcgattgtttcaggaaaaattaaaggaattgcagcagttgtcggatgctctaatttaagagcaaaaggacatgatgtatttacagtagaacttgccaaagaattaattaagaaagacattcttgtattatccgcaggctgtacttgtggtggtttagaaaattgcggacttatgacgatggatgcagtagaactttgtggggaaggattgaaagaaatatgtacagcacttggtgttcccccggtacttaactttggtccatgtcttgcgattggacgaattgagatggctgcctgtgcattagcaaaagaactgaatgtggatctgccacagcttccagttgttatcagtgccccacagtggcttgaggaacaggcgttggcagatggagcatatgcacttgcacttggattccctctgcatctggcattatcaccatttgtaacaggaagtcaggtagcagtgaatgttcttacagaagggttaaaggatttaaccggaggccagcttattattgaaacagaagtagatgctgcagcacagaaatttgatgagattattaaagaaaaaagagcaggtcttggaattgatagtggaatcaataaaggaggagatgccatatgctaatgaatcgaacgactccttttatggttccagtagatgatgcgaatcctgcgattataaaaaatgaagcattatgtagtgagtgcggacattgttttgcggtttgtgaagaagagatcggggtagcagcaaaatatttattaaatcaaagggaagcatatcaatgtattggctgtggacagtgcagtgcagtttgtccggaaaaagcaattaccggacgtcctcattataagattgtgaaggaactgatccaagatccggaaaagattgttgttttttctacttcaccatctgtcagagttggttttgcagacggcttcggaaaagagccgggaacatttgcacaagatgagatggtaggtgcattgcgtgcacttggagcagattatgtatttgatgttacattttctgcggatcttacaattatggaagaaggttctgaacttttgtctagaattttaaaggggaccggaccacttcctcagtttaccagctgctgtccagcctgggtaaaatacatggagaattttcatccggataaaacgaaatatctttcttctgcaaaaagtccgatcggaatgcagggagcagtaatcaaaacatattttgcacataaaaaacatattgatccggaaaagattatttctgtagcagtgacaccttgtacagcgaaaaaggcagaaatagcaagagaagagttatgtgatgcaggaaagcttcttaatatagaagaaatgcgtgacaatgattatgttattacaacaaaggagctggtacagtggtgtaaagaagaaggaatggatttagggaaaatcactccttcaaagtatgacagtgtattaggagaaggaactggagccggaatgattttcggaaataccggcggtgtaatggaagcagcacttcgaacggtttacagagttttagaagggaaagaggcaccggcagatttttatcagcttcgtccggtaagaggattaaataaccgaaaagaagcggaagtgacgattgcaggaaagaatctcagagtttgtattctgtatggaacagcggctgcggaagaatttctggcagaagatatgagtggatatcattttgtagaagttatgacatgtccgggaggctgtattagtggagcaggacagccggattgtggaagtgttccagtatcggatgcggtaagaaaaaagagaatcgcatcattataccaggctgatgaacgggcgcaatacagaaattctatggataatccggaaattggaatgatatataatgaatttttcaaagaaccattaagccttttatccgaaacacttttacacaccacatataagagtaagtaaggaaaaaaagagtgcaaaatagttcgaaaatgaggattaaattttccaactaaaaaaacgatgcaaaatgagaaattcttgcctatattttcttggcaatgataccaatttgtttcatatcgacagatgtaattcgttgctgttgcaataaaatgtgacagcaacgtttctttttgttgtgcaaactgtataaatataaaaaatatctgattgataattgctatatgacggagtataattataattaaatacactggaaaaatggaggaattacatgaaagcacataaatattggtcagtaggagcattagtcacaatgcttgggaccttttacactggatataaaaagctaaactcaagtcacaaatactttgctttaagttccatgttatgtatggtaatggcgatatatacaggtcataaaatgattaccgggaataggaaagaaaaggcaaaaaaagagaaagttacagagggtgaggaataaataatgctggaagtaggaatcaaggcacctgattttgagttgccagatcaaaatgggaaaatacatagattatcggattatacaggaaaaaaagtaattttatatttctatcccaaggataatacagcaggatgtacgaaacaggcatgtggcttttctgagcgttatccacagtttactgagaagggagctgttattctcggagtaagcaaggactctgtagcgtctcacaagagatttgaagaaaaatacggactggcatttacgctattagcagatccggagcgtaaagttattgaagcatatgatgtctggaaagaaaagaaaaattatggaaaagtatctatgggtgtagtaagaactacatatcttattgatgagcagggaatcattataaaggcaaatgataaagtcaaggcggcagatgatcctgaaaatatgcttaaggaattggcataatgaagattattttatcacctgcaaaaaagatgattgtagataccgataacttagcaccggttgaactgcctgtctatattgataagacagcagaagtattaaactggatgaaaagcaaatcaaaagaagaactgaaagctatctggaaatgtaatgacaagattgcagagcagaactttaacagattggaaaatatggatctttataacaggcttactccggctgttttagcatatgaagggattgcatttcaatatatggcaccatctgtgtttgaaatccagcagtttgagtatttgcaaaatcatttaagaatcttgtctgcgttttatggcattttaaaaccaatggatggtgtgactccttatcgtcttgaaatgcaggcaaaggttggaattggagatgcaaaaaatctgtatgagtactggggagaattgttataccgctcagtaatcgatgacagtaggattatcattaatcttgcatcaaaagaatactcaaaatgtatagaaaagtatctgacaccacaggacagatatattacgattgtattttgtgagttatcaggagataaactggtgacaaaaggtacatatgctaagatggcacgtggtgaaatggttaggttcatggctgaaaatagtattgaaaatcctgaggatattaagaaatttgatagactaggttattcattccgctctgatttatcatcagatgcagaatatgtttttgaacggaaaaaagaataattaaatgattaatttaaataaaaggcagtctgtaatgttaatttattatgataataagagctgttgctgttattaattgacaatagattaaaataggcatataattctaactaataataaatcctaataaaggagaggggataataaatagaagaagcacaattcagaaagatctgctaagaaatactgtatctgagatgaaaaagcatgtttcagtaaatgaagtttatgaccttataaaagaaaggtatcctacaattggaaaaggaactgtttatagaaatcttgatatattggtagagtaaggtgcatttagaaagattgaagtcccggatggaccgaacagattcgatttcatattgaaaaaacactaccatgtcaggtgtgtagaatatggtgagatttcagatgtggatatggacgaaatatcggacttgttataaaaaaatcataatactcatgaaattgaatttttagattaggatatttcatttaaaggtatttacccaaaatgcaaggaggaaaattatggatgagaaagcaatgtataagctgagttatggattgtttgtattgactgccaaggaagatgaaaaagacaatggatgtattattaatacagcaattcaggcggcttcagaaccaaaccaactaagtatctgtgttaataaagcaaattatacgcatgatatgatcaaaagaactggaaaatttacagtatcagttctgagtcagagtgtggagtttgaattatttaaacattttggcttccaatcagggagaaatatcaataagtttgaggcatttgataagtgtgccaggagtacaaatggtgtttattatattacggaagggacaaatgcatacatttctgtaactgttaataaaacagaagatttaggctcacatacgatgtttatcggtgagataaccgatatggaaactttaagtaatgttccttcagttacatatgagtattaccagaataatataaaacctaagccaagggaagttggaaaaaccgatgatggtcagacaatatggcgttgtaggatttgcggatatgaatatgtaggtgaagaattacccgatgattttatatgtcctatatgcaaacacccggcatcagattttgaaaaagtagttaaaaaatggaggtaaatgaaatggctacaaacaaatacacaggaacacagacagagaaaaatttacaggaggcatttgcgggagagtcccaggcaagaaataagtacactttttttgcttctgttgcaaagaaagaaggctatgagcagatgtctgcactatttttaaaaacagctgataacgaaaaagaacatgctaagatgtggttcaaagaattagcgggaattggtgatacaaaagaaaatttagcagcagctgccgaaggtgagaattacgagtggacagacatgtatgaaggtttcgctaaaacagctgaagaagaaggttttccagagcttgctgctaaattcagagcagtaggagagattgagaagcatcatgaggaaaggtaccgtgcacttcttaagaatattgaaactgcacaggtatttgaaaagagcgaagttaaggtatgggaatgccgtaactgtggacatgttgtggtaggaacaaaggcacctgagatatgtccagtatgtaaccatccacagagttattttgaagtacgtgaagagaactattaaagagaagagattattataaataagcaagtgattattaaaaaaagcagtaatgataggctgtggttttgttggttctgcatcaattggtgaagaagcattaaagttaaaaaaatcggcggctgctttgaaaaagttacagaaataattggattttaaattttaaacataggagataaaaaagatggaagtaaaatattatgtatgcaatcattgtgagaacattattgaaatggtaaaggataaaggtgtacctgtgatttgttgcggagaacctatgcaggaattaaaagcaggagtgacagatgctgctgttgagaagcatgtacctgtatatacagtggaaggtagtcatgttcatgttgtagtcggagagacaaaacatcctatgcttgaagagcattttattgagtggattacattaagtaccaatcagggaatatatagaaaacagttaaatccaggacaggagccagtagcagatttttgtctttgcgatggtgaattggtagaagaagtatatgcgtattgcaacctgcatggattatggaaatgctaaaaacatttgacattcgtgctaagattacaaaataattcagatacaacagtaatatatgctgtgtattaatatatttataaggaaaaacaaactaatgaaatatgtatgtgacgtttgcggatgggaatatgatgaagaagaaggttatcctgaaggtggtattgcaccaggaacaaagtgggaggatgttccggaagattttgaatgcccattatgtaatgttggaaaagatcagttttcagaagttgaataaaattctgattatttaaataaggatagataaacaaaaaccctggtgcgtgtgagcaacagggttttttattgcgatagtctgtgatgatatcacagaaaatgatttaccttttgcttataatgtaactacaaacaaagtaaggaggtagtctaaatgagattaaaagataaagttgcaatcattacgggtggaagccgtggtataggatttgctacagctgataaattcttgaaggaaggtgcttcagttgtactggcagcaagttcacaggaatcggcagatgttgctgtagataaattaaaagaaaaatatcccaatgcaatagttgctggaattagtccaaatctggcaagcatggagtctgtcagaaaggcttttaaagaggcaactgaaaaatatggatgtgtcgacatactggtaaataatgcagggatttcagaaaacactccatttatggattatacagaggagactttcgataaagtcatggatctaaatgtaaaaggagtatttaatactactcgtatagcagcagaatgtatggtggcaagaggcaagggggtcattctctcaacttcttccatggtgagtatttcgggacagccaagtgggtttgcttatccggcatcgaagtttgcagtaaacggattgactgtatcattagcaagagaactaggacctaaaggtattcgtgttaatgctgttgcacctgggattacagaaactgatatgatgaaggccgtgccaaaggaagttatcgaacctatgattgaaagaattccattgcatcgtcttggacagccagaagatattgccaatgcgtttgcgtttcttgcttcagatgaggcgagttacattacaggtgttatattaagtgtagatggtatggcaagaagttaagttaatgaggtatggtgatgtaatcacggaaaataaatgaaattaagactataataaatctacaaaaagaaaaagataaggaggacttctaaatgagattaaaagataaagttgcaatcattacgggtggaagccgtggcataggatttgctacagctgataaattcttgaaggaaggtgcttcagttgtattggcagcaagttcacaggaatcggcagatgttgctgtagataaattaaaagaaaaatatcccaatgcaatagttgatggaattagtccaaatctggcaagcatggagtctgtcagaaaggcttttaaagaggcaactgaaaaatatggatgtgtcgacatactggtaaataatgcagggatttcagaaaacaccccatttatggattatacagaggagactttcgataaagtcatggatctaaatgtaaaaggagtatttaatactactcgtatagcagcagaatgtatggtggcaagaggcaagggggtcattctctcaacttcttccatggtgagtatttcgggacagccaagtgggtttgcttatccggcatcgaagtttgcagtaaacggattaactgtatcattagcaagagaactaggacctaaaggtattcgtgttaatgctgttgcacctgggattacagaaactgatatgatgaaggccgtgccaaaggaagttatcgaacctatgattgaaagaattccattgcgtcgtcttggacagccagaagatattgccaatgcgtttgtgtttcttgcttcagatgaggcgagttacattacaggtgttatattaagtgtagatggtatggcaagaagttaagttaatgaggtatggtgatgtaatcacggaaaataaatgaaattaagactataataaatctacaaaaagaaaagataaggaggactgtaaaatgtctgctattaatatcaataaaaataattttcagaacgaagtactgaattccgataaacccgttcttttagatttttgggcatcttggtgtgcaccttgccgcatggtagtacctattgtagaggagattgcaagtgagcgtagagatattaaagtaggaaagattaatgtagatgaagagcctgaactggcaaataagttcagtattatgagcattccgactttagtggttatgaagaatgggaagattgtacagcaggtttcaggggcgagacctaagaatgcgattttagaaatgctttagggaggtgtgctaatgggattttttgatctctttaaacagtcgaatattaatcaaggtatagaagaatataaaaggactgatgatgcagttctgctggatgtacgtacaccgcaggaatatcaggaaggacatataccagaaagtaaaaatgtgccgttgcagcaacttgacaatattgcttctgtagcgtgggataaggctatcccactgtttgtatactgttattccggttcacgaagccgccaggcaactgggatactgcaacgaatgggatattctaaagtaaataatatcggtggcattgcagcttactcaggaaaggtggaaaaataagatgaaggtaataattgtaggcggtgtagccggaggagctacagccgcagcaagaatacgcagactgaatgaacatgctgaaattactgtgtttgaaagatccggatacatatcctatgcaaattgtggacttccatattatattggagacgtgatcacagacccggaagaacttacactacagacaccagagagtttttttaaacgcttccgtattaacatgaaaattcatcatgaagttatctccatacatccggaacgtaaaacggtttcagtgaaaaatttagagaatggtgagatatttgaagaaaaatatgataagctgatcctctctccaggtgcaaagccaacacagccgagacttcccggagtaggtattgataaactttttacacttcgtactgtagaagacacttttcggataaaggaatatataaataagaatcatccaaaatcggttgtattggcaggtggcggttttattggtctggaactggcagaaaacttgagggagcttggcatggatgttacgattgtccagcggcctaagcagctgatgaacccttttgacccggatatggcatccatgatccataatgaaatgagaaagcatgggataaaactggtactgggctatacagtagaaggatttaaagaaaaagacaacggagtggaggtcctgttgaaagataatccatcccttcaggctgatatggtagttctggcaatcggagtcacaccagacacagtattagcaaaagaagccggtctggaacttggcatcaaggaaagtattgtagtgaatgacagaatggaaacctctgtaccggatatttatgctgcaggtgatgcagttcaggtaaaacattatgttacgggtaatgatgcgctgatttctttggcaggaccagccaataaacagggcagaatcatcgctgataatatttgtggcggtgatagtcgttacctgggcagtcagggaagctccattataaaagtgtttgatatgacagcagccactacaggtatcaatgaaaccaatgccaaaaagtcaggattagaggtagatacagtaattctttctcctatgagtcatgccggttactatcctggtggaaaagtgatgaccatgaaggtggtttttgaaaaagagacctatcgtttgcttggcgctcagattattggatatgaaggagttgataaacgtattgatgtgctggcaacagcaattcatgcagggctgaaggcaacccagctgaaggatttggatctcgcatatgcaccgccttattcctctgccaaggatcctgtaaatatggctggattcatgatagacaatatagcaaaaggtaccttaaaacaatggcatctggaagatatggataagatttctagagataaaagcgttgtgttgctggatgtgagaactgtaggtgaatttaacatggggcatatggatggattcaaaaacattcctgtagatgaactaagggaacgtatcaatgaaattgagaagggaaagcctgtttacctgatatgccagagtgggctgcgaagttatattgccagtcgtattctggaaggaaatggatatgaaacatacaacttctccggcggatttcgcttctatgatgcagttgtcaatgaccgtgcgctgattgaaaaggcatatgcatgtggtatggattattaaaaataatcataatatttttataattttctcgtaatataaaaagatcccccatttattagaatgactttcataattctgataaatggaggattcttctttatatgttacagaaaaacaattttatgacctttggagtgtttccagtctttttggatcaaggattgtgattttgccgcgggagagtttgacgagaccctcgccttgaaagtatcgaagcattcgagtgataacttccctgtgggaaccaagatgattagcaatcgtctcatgagtgattttcagctcgtttgttccttcgatagaggtctcttctaaaagaaatgaagcaacacgcttatccaaactcttccacatgatttgttcaatcagccacatgacatcagaaaaacgggtagccattaactcattggtatagtttgcgacgggagcagattccttcataatgcccttatagatttcagcagggatgatccaaagatcagtatctttttctgcttcaatggttacttcaaattgaatggagcgtatgatacatgaggcggataaaagacacatatccatatcgaacagacggtaaagtgtaatctcccgtccttcatctgaaagtatgtaagttcgaagctgcccggatttaaccagtaataatccggtacaatccaggtttccgttgtgaatgatcgtttctttttttacattccgtgtaatcaaattgtctgaaattagttttttctgtgctgtatttaagtcattccatagtggaaaataattctcaaagctcataatagttatctcctttgaacatagtatacttaattttttgagaagcgtcaactatatagctgacatatgccacaaataaaaataaaaagatgcacaataaaacacatcgttcttttgtgtgatatcatcatgaaaacaagattttttgtgcagagaagatagatattttatcacagcatctattaggaattattaatgatgtgctggatatgagtaatattgaagcagggaaaatagtctttaagtatatagatttttaccttttagattttattactaaattcaataccatgttccattcacagatagctgagaaaaatcagacgcttactgtcacaaaagaaaacatctagcatgaatggatgaacgaggattaggttcatctgatgtaaatttcagaaacttactttctaatgcaatgaaatacacacaggaaggtgaaaaattcagtttctgctagaagaatgtgagacaaagtcatctgtctatgcaaagtaccgtttcttagttagagataatggcatgggtatgtcagcagatttcaaaagtaaaatttttgatccgtttccccatgctgagggttctgtgactaataagatacaaggaagcaatcttagaatggctattaccagaaatctggttggtaccattgatatggagagtgaactgaggcagaaaagctgttttgaggttctcatagatttgagaattgcagaagatagatttgtgtcttcagcagtacgggaagaaaagaatgaaaaggttgatagtatcctttaaggaaagagattcttgtgtacggaggataatgaattgaatgtagagatattaaaggaactgttaaagatagaaagtgcagagtgcacaatctgtgagaacggtgaaaaaatcttagaagaatttgaatattatgatctaggagagtatgatatgattctgatggatgtacagatgcctgtcgtgaacggttatgaggtaacaatggcaatccgcaggagttcctatgaactggaaaagacgattccgattatttttatgactgccaatgcattttcagaagatatacagcattctctgacacttggtataaatgctcctgtttagaactatctatttcctgatagctccttctttttttgattttttcaaaattatatggcattttttactctcacatatgtgattagtagaaaaataattttctgtgaaagtaccgtctaaatatactctgaagcttgcagttagtgaaggaatatttcatttatgcgaaaaaacttgtaaaagaggtttgctaaataccctatcaaaagctttataggtagagtaacaaaattttttcatatttttttcaaaatcatgtccgattttatcttttccaatacagaataaggggaagggactaacaaaagtaaaagaaaaaataatgaaaatataaaaaaataaatgtttatatttgatttgttgactatactaatattattcggtataattttgttataagggaggggagaaaatgataacaaaaaaaagaaaattatctgagcggaaacttatggctttatcttgtggaagttatttattggggattgtatgtatgactattttaggatatctttatgataaaataccatgcagaaatttcttgtatattattccaatttgtttattaatacttggagcaattttttcatgtatgcttcatattatgtatccaatttttataattgaagaagtatctaagaaagatataaaagaaatgactacgaaaaaagaataggaatagattaaaaatccagggcaatgtgtaatttttcaatatactattcaaccctttttatttttaaaaatatacttctgaacttaaaactaaatacttgcaaaataggcatctaataattttctatcattacaggtacaatagaatcatgtaatgatggaaatgaggtgtacttacttgcatatagagaagtatgttgcgaagaatataatttctttgtgtgaaaagcgtgacattagtaaataccgattatcgcagttgtccgggatttctcagtcttcgcttagcaggattatgacgcaggaaagtctgccgtcattgattactcttgaaaaaatatgtgtagctttgggagtaactttatcacaatttttcagagaagaaaatccagtagatttaacggaatcacaaaaagaaatacttaaaatatgggacaatttaagcacgaaagaacaggagacagttttagcaatgcttagaggtcttcagaaatgaagaaacagttcaaacatatatgtttggctgtttctttttttgtgtgaataaatagagagttagatgtaatcttaattatctaaaaattgaaatatttataaagaaattaacaagaaagataataaaaaaatactagaaataactaatgcttatgagatgaaaaaatgtatattttaataaaaaaatctaataatatatattatataatcattactatttaaaaaataaatactatgttaaaatatttatggcgttctgcaaacacggaacgtctttttttttgcaaaaaaataattttttacaaaaagaaccgaaaaaacagggtgtcccattcgggataaagaatgaaagggggaaatcgttgctttttgtaggaagggggtgagccttaatggagcaatcaccttcttacaaaagaaaaattcaaattcaatttcaggcatactgttataaaattttgcgaggtgaagcagttgactattatcgttatgtaaattatttgcaaaaacatgagaaatctattgagagtttatcatcggaagaatctggtgaactttatgtatcagatgaatacaaatcagatgatcatctgtttaaagtattggaatatgacatagggataaaaagtgatttacttgctgaagtattacatctgttatcacaaaagaaaagagatgttatattactttcatttttcttgggtatgagcgatacagaaattgccagaataatgtgtgtagtaaacagtacaatacatgagcataagaaaaaagcacttaaattgatgaaaagtgaactggagaaaagaggaatggaggaatagttacaatgcaaaaagattcaagaaaaaatgaagaaagattattaccttttgaaacgattaaggcagctacggaaggagatgtagatgcgatggataaaattttaaagcattataaaccttacatagtgaaattatcaattcggacagatggtaataaaagctacattgatgaagacttgcgagaacgtttggaggcaaaattgattgctaagactttagaatttgagactgcttagtttgaatatgcgatgactttctttcttagataactaactgtactttgaaaatcaaatgattttgccatttgtatgtaacagacttatgccaggataccggtgaggtggagcaaagatataatgatacttctgattgggcagtcggctcatagaccttagagccggaaccatacaattttatggttaaggtaatctgcaatgattacgcagcaaatgggtatacaaaacaacctataaattatattttcatagtttatgccgaatttgacaatgaaagccgtgtggcaggatatgacttattaagtaatcctgccacattcttttggggtcaaagctaaacgggaggagaaaatggataatacaaaattactaagatacagcttgcagttatcaatgcttaaacagttgttacagttgaaacttataagcgaaaaagagtatcaattaatagaaaaaacaataaaaaaagattatagtgtagtatcgagtattactacttgactatttctgtgtattataatacaattatagtatcactacgataggaatacaagaaaggcgaggatatggaagttaaaataattaaagctaacacacctacagaactttcttcaaaaagaaagatagagagattaagagtagcagcctattgtcgtgttagtactgatgatgaagaccagactaagagttatcagtctatgattaaatattacacagatttgatacagaataataaacagtgggtatttgcaggaatatttgcagataaggcaatcacaggaacaaaggcagatatacgtgaagaatttcagagattgattcaagaatgtctatctggtaaaattgatttagtaattgcaaaaagtattccaagatttgcaagaaatacattagatactttaaaatatgtaagaatgttaaaggaaagaaatgttgcggtatattttgaagtagaaaaaattaataccttgaaggatggagaatttttattaacaattttaagttctgttgcacagcaagaagtagaaaatacctctgcatatgtaaaaaaaggcttaaaaatgaaaatgaaaagaggagagcttgtagggtttcaaaaatgtctagggtatgattatgatccattaacaaaaacactttctattaatgaagaaggggcaaaaacagtaggctatatatttaagagatatgtagctggtgcaggttccactatgattgcacgagaattgaacgaacaagaaattccaacagttcatggaaatcggtggtctccttcaagtgtgatgggaattattaataatgaaaaatatatgggagatttattattaggaaagtctttcacagtagatccgatttcaaaaagaagattaacgaatatgggtgaggaagaccgtttttatatagagaatcaccatgaagctattatatcaaaagaaatttttgaaaaagctcaagaaattcgtcagcgccggagtaaggggcgggtaaatggagtagagactggaaaaagagaaaaatatagtagacaatatgcattcagcagtatgttggaatgtggcttttgtggagagactgtatcaaggagatgttggcatagtcattcaaaatacgaaaaaattatatggcattgtggaaggaatataagaaaaggaaagcgtttttgtccagaagctaaaggcattccagaacaagttatagaaaaagcttttgttgaatcttatcagatgctatgttctgatcacaaagatgtattagaagaatttataaaaaggattgaagagacattgtctggcgattcaataaaagacagaatcaaaaagatagatcagtctattcgtaatttgaaatataggagaagaaaattattagataagtatttagatggaggtattgctaaagatatttatgaagaggcagatttagatttagataaaaaaatatttaaagcaaaccaagatttgattgaattggaacaacaatacaatagtgaaaacagtttgcaaaagagacttaaagattttaaaaaagcattactaaaaaatcagacattggaagagtttgatagagaaatatttgaaagtattgtcgaaaaggttattatcggcggttatgatgagaatggaaaagaagatccctataaaataattttcatatataaaacaggattcaaagacgaaattgaaaatgcaaagaaacgatatgaaaacacatcagggagagtggatggaaaattgtgttcctatattacaagcgaggtaaaagatttgtatccttgtaatagtgacaacacacattgatcctgttgaatttgatggagatggagacatggatgaccataatttcaattaattttacaggaatcaattagaaaaagttctgttctctggttgacaaaatgggcggtcacgagtataatcataaacagttttaatgcgttaccactttattgtgacagagtgtttaaagggcaagaagattgtcacaaaagagtctgtgaatgcaggctctttcttttatttttttatgagaatagctcagataattttataaaagcggtgaatgagattttaatttaggaggataacattaatgaaagaaaaactgctccacactccagagggagtaagagatatttataactcagaatgtaagagaaagtcagcggtggagaagcggattcatcatatattagagctttacggctatcaggatattgagacaccaacatttgaattttttgatatatttaacagtgatacaggaactgtaagttctgtagagatgtttaagttctttgatagaaataataatacattagttctccgcccggatatgacgccttctattgcaagaagtgtggcaaagtattatagtgcctgtgaatttccacttcgtctttcttaccgcgggaatacatttttaaataacagaagttatcaaggtaagcttactgagaagacggagatgggagcggaacttattaatgatgacagtccggaagcagatgcagagggaatcatcatgatgattgactgtttccttgcggcaggtcttacggattttcgtatagatatcgggcaggcagagttttataaaggaattatggatgcgttagaagcttctgaggaagttaaggagcagattcacgaatatattgagaataagaatgctcttggaatggaaattcttttatcggatttatctatgaaagattgttatcgtaacattctgcttgagtataatgatttatatggtgatgttaccatgcttgaaaaggcaaagaagcttacgataaatcctcgttgtcaggcagcaattgccagactagaggaagtgtatgaagtgttaaagctttacggttacgaaaaatatgtaagttttgatcttggcatggtgaaccattttgattattatacaggaattattttccggggatatacttatggaactggagatgcgattggaaaaggtggacgttatgataaccttttagcgcagtttggtaaggaagcaagtgctagcggatttaccattttgattgatgatgtactatctgcattaagccgtcagaatatcagcatttccttaaaagaatatgcctattctttacttctttataaatcagaggacagacagaatgcgattccgttagttgtaaagttaagagatgccggagtgcggacggaactcgtttccatgacagaaggaaagacgttagaagaatatcttgcttttggaaagaatcagggagcagaaggaatcctctatttagatggggagaatgtcactgtttatgatatggcttccggagagcaggagacaaagacattacaggaactcagggaggaatattaagatgcgctatttaacatttgctctggcaaagggaagacttgccaataaaacaatggatatgtttgaaaaacttggtattacctgtgattccattcgtgataaagagacaagaaagcttatttttgtcaatgaagatttaaagcttaagtttttcttagcgaaggcttctgacgttcctacttatgtagagtacggtgcagcggatatcggtatcgtaggagaagatacgattcttgaagagggaagaaacctttacgaagtaatggatctgggctttggaaagtgtaagatgtgtgtctgtggaccggaaagtgcaagggaaaagttacagcatggagagcttattcgtgtagcttctaagtatccaagcattgccaaagattatttttataataaaaagtttcagaccgtagagattatcaagttgaatggttcggttgaattagctccgattgttggactttctgaggtcattgtcgatatcgtagaaactggttctacattaaaggcaaacgggcttacagtcttagaggaaatttgtgatctttctgcccgtatggtagtaaatcaggtaagtcttaagatggaacaggagagaatccgtaaactgatttatgacctgcgtaaactgaagcagcaatagatggttaaaaatagaaacaaaaataaattagaacattccagaggaaaagaaaatgagagttttaaaggtaaataaagaaaatacaaaaaatattttaagtgatttattaaagagaagcccaaataactatgaccagtatgccggaacagtacagggtattttagatgagattaaggaaaagggagatgaagctctttttgcttacacagaaaagtttgataaatgtaagctgacaaaagatacgattcaggtaacagaggaagaaatcaaggcagcatatgaaaaagtagatgattctttagtagaagttatccgtaaatctcttgtaaatattcgtgagtatcatgagaaacaaaagagaaatagttggtttgatgccaaaccggatggtacgattcttggtcagaagatgacagctttagcttctgttggcgtgtatgtaccgggtggaaaggcagcatatccgtcttctgtacttatgaatattgtaccggcaaaggtagctggagtagaaaaaatcgtgatggttactcctccaaataaagatggagaagtaacaccggcaacattagtagcagcaaacgaagcaggtgctactcatatttataaagttggtggagcgcaggcaatcggtgcattagcttatggaacagaatcaattgaaaaagttgataagattgtaggtcctggaaacatttatgttgctcttgccaaaaaagcagtatatggacatgtaagtattgattctattgcaggaccaagtgaaattcttgttcttgccgatgatacggctaatccgcattatgttgcagcagatttactttcacaggcagaacatgatgaacttgccagcgcgattttagtgacaacaagtaaaacacttggtgagaaagtgcaggaagagattgaaggttacttaaagaagttatcaagagcagagattattgaaaaatctcttgaaaactttggctatattttagaggcagagacattagatgaagcgttagaagtagtgaatgcgattgcttccgagcatcttgaaatcgtgacagcgaatccatttgaagtaatgactaaggtaagaaatgccggagctatctttattggagagtatagttcggaaccacttggtgattattttgcaggaccaaaccatgttcttcctacaaatggaaccgcaaagttcttctctccgttaaatgtcgatgatttcgtaaagaaatcaagtattatttattattcaaaagatgctttgaaagcgattcataatgatatagaaacatttgcaaaagcggaaggattgacagcgcatgcaaattctattgctgttcgttttgaagaggaggagtagagatgccagaaagaaaagcgcgtgttgagagaaataccagtgagacaaagattgttgttgagctgaatttagatggcagtggaaagtatgatattgatacaggaatcggtttttttgatcatatgttaaatagttttgcacgtcatggcttttttgatctgacctgcaaagtagatggagatttagaggtcgattgtcaccatacgattgaagatacaggtattgtacttggacaggcaattcgcgaagcagtaggagataaaaaaggaattcgacgttttggaaacttcctgcttccaatggacgagacgcttgtacttggtgcggtagatttatccggaagaccatattgcgtgtgtgatttgccatttaccgtagaaaaagtcggtgggtttgatacagaaatggtacaggaatttttctatgcagtttcttacagtgcagcaatgaatctgcatttaaaattaatacatggaagtaacaatcatcatattatggaagcagcgtttaaagcgtttgcaaaagctttagatgaagcttcttcctatgatccaagaattacagatgtactttctacgaaaggagcactataaatgaaaagcaccatttcttttgacgaattcaaattaaacagtgatggaatgattccggttattacacaggattataagacaaatgaagtattgatgcttgcctatatgacaaaagaatcctttgaaaaaacattggaaacagggaaaatgacttattttagccgtagccgccaggaactttggacgaagggagatacttccggacattatcagtatgtgaagtctttagatattgactgtgataaagatacgattttggcaaaagtagagcagatcggagctgcttgtcatacaggaaaccgtacctgtttctttacaagacttgcgcaagaggagtaaaataatacaaataagggaaacatagaaattataagaaatatagaaaaaacagataaaaattgagattaagattaagataaagattaatagaaagaagctgaaaaaagaagatatgagcgatgtagaagtaaaatatcagagattactggattatttaaaagaacttggatcggtagcagtcgctttttccggaggagtagattccacctttcttttagcagcggcgaaagaagcattaggagataatgtgattgcgttaactgcaaagtcctgtctttttccggaaagagaatcaaaagaagcacaacaattttgtaaaagtcttggtgtggaacagatagttcttgatttaggagacaccgaactgcatcattttaaagataatccgccaaatagatgttatatttgtaaaaaaggtctgtttgaaaaatttttacaaaaagcagaagaataccagatggcatatgttgcagaaggttcgaatatggatgatttaggggattatcgaccgggaatgcaggcaatcacagagcttggaataaaaagtccgctacgggcagccgagcttaccaaagcagaaatcagagaactatcccatcagataaatcttcccacatggagtaaaccatcttttgcctgcctggcttctcggtttgtttatggagagacaataacatcagagaagcttcttatggtagaacatgcagaagagcttcttcgggaaaaaggatttcatcaatttcgtgttcggattcatggtacaatcgcaagaattgaactattgccggaggatatttcaagaatgtttgacgaaaaacttcgaaaagaaatcgtagataaactcaaacgatacggatttacctacgtttccctggatctggaaggttaccgaacaggaagcatgaatgaggtgctggcgtaggaattactacatcagtgatagaagatttgaggatgtttgttcgtctgttcatttcaacgaattaaatcagaaaaaggtttacagttttttatgaaatatggtatactaactttatgtaaccgaaaacattttcagtatgagaaggagggcctttactatgtcggctgtattaagtgcatttgttcaatatattataacgtttattttgctggtagcagccgcggccggaggtattttttgtggaaagaagttaagaacgaagaagaacatggaaagcaatacggctggtactgaaaatacatcaggtaaataattaacatagcgatatattttagggtgctgacggagaacggattgttttctgccagcaccctttcatgtcggtataaccggcattaatatatgcgatactataggaggacagaattttgaaaaagtatggagtaaacgaacttcgaagaatgtatctggagttttttgagagcaagggacatcttgcaatgaagagtttctcactggttccacataatgataacagtttattactgatcaatgcaggtatggcaccattgaaaccttattttacaggacaggagattccaccaagaaagagagtaacaacctgtcagaagtgtattcgtaccggtgatattgaaaacgttggtaagacagaccgtcatggtacattttttgaaatgcttggtaacttctcttttggagattattttaaacacgaagcaatcgcatggtcatgggagttccttacagaagttgtagggcttgatgcagacagattatatccatctgtatacttagaagacgatgaggcatttgctatctggagagatgagattggaattgctccggaacgcatttttaagtttggaaaagaagataacttctgggaacatggtgcaggtccttgtggtccttgttctgagatttattatgaccgcggagaaaaatacggctgtggtaagccaggttgtacggtaggttgcgattgtgaccgttacatggaagtatggaacaacgtatttactcagtttgaaaatgacggacataataactatacaacattaaaacagaaaaatattgataccggtatgggattagagcgtcttgctgttattgttcaggatgtaggatctatctttgatgtagatacgattcgttcccttcgtgacaagatttgtgaagtagcaaagaagaattataaagagaatgaacaggatgacatttcaatccgtctgatcacagaccatatccgttccgctacatttatgatttctgatggtatcatgccaagtaatgaaggtcgtggctatgttcttcgccgtatcatcagaagagcagctcgtcatggacgtttacttggtatcgaaggtaagtttttagcagaacttagcaagacagtgattgaaggttctaaagacggttatccagaattagaagaaaagaaagatttcatttacaatgttattattcaggaggaaggtaagttcaacaagacaatcgatcagggccttgcaatccttgctgatttagaagaatccatgaaggaaaaaggtgtaaaagaacttgatggtgaagatgccttcaaactttatgatacgtatggattcccattagatcttacaaaagaaattcttgaagaaaaaggatacactgtaaatgaagaagcattccaggcttgcatgaatgagcagaaagaaaaagcaagaaatgcaagaaagacaacaaactacatgggtgctgatgttactgtttacgaatcaattgatccatctgtaacaagtacttttgttggatatgatacacaggaatgtgattctaagattacagttatgacaacagatacagagcttacagaggcattaactgacggacaggcaggaacaatctttgttgatgagacaccattttacgctacaggcggcggacagcatgccgacagtggtgtgatcacatgtaaagatggtgaatttgttgtagaagatgttgtgaagatgctcggtggtaagatcggacatatcggacatgtcacaaaaggaatgtttaaagttggtgatacggtaactttatctgtaaataaagcgcagagagcagacacagcaaaaggacacagtgcaacacatcttcttcagaaatctttacgtaccgttcttggaaatcatgtagaacagtccggttcttatgttgataaagaccgtcttcgttttgacttctctcacttccaggcattaacagcagaggaaatcgctgaagtagagaagatggtaaatgataaaattgcggaagatatcgctgtaaaaacagagattatgagtgttgatgaagcaaagaagactggtgcaatggcattattcggagaaaaatatggtgacaaagtacgagttgttacaatgggagacttctccaaagaattttgtgcaggtacacatgtaccacacacaggagtaatcaaagcatttaagattatttctgagacaggtgttgcagcaggagtaagacgtatcgaggcattaaccggagacggtgtaatgaaatattaccttgatgaagaaaaaacacttcatgaagcagcaaaagcagcaaaggcagagcctcataaattagcagaaaagattcagtccatgcttgacgagatcaaagcacttactgcagagaatgaaaagttaaaagatcagattgcaaagagtgaagttgcagatgtaatggatcaggtagtggcagcgggcgattacaaagtacttccagtatccgtaaaagacgttgatatgaatgctctgcgtactttaggtgatgatcttaaagataagattggaagcggtgttattatccttgcttccgatatgtgcggaaaagttaacttaatcgtaactgcaacagatgatgctgtaaaagcaggtgcacatgcaggaaagatcatcaaagaggcagcagccttagtaggtggcggcggtggtggacgtccaaatatggctcaggc

SEQ ID NO: 430 - DNA, 30965 bp, Eubacterium hallii
ctttcggcttatctgcctttttcttttcctctgctttcggcttatctgcctttttcttttcctctgctgttgagacaacttctgttttctcaacagcatcctttatttctgttgaaacagttttcacagttgtttttttggtattgattctcttactcataactctctccaatccatgaaatgatgatacacacgttgatgttttatctctttactttatataattattttaacaaataacacaactatagtcaattaaaggaagttttaaattctcaaaaaattcaattccgatttgtaaatttcgtatagacgagaatggggattttccagaaggttatgactttccatggaattaaattctaaaggatttacatttaaattgttgtatatacttgaaatttagttacatcagatgtgagataacttcacatctacaagacatctcttaataaaatttttttcttccgaagattttatctgaataaaaatcgtagatttctggacaagccctcttttttttaactgagttgcggaataagattaaacagccactgtaatagaactctttgctgaattgtaagaaaactatggcaaaaaagagaatttttataagtttgcttttgttccgttacgctaaacgcttcattttgcctcaaaaaaacgaaaacttcggaaaaacaaggggattctccaaagaatttttgaatgtcagccctttagaatttaatttcctggaaagtcatatccttctggtacattccatgttgccaaactgtggatttagaatagtcagaaaaaagaaataataccctatcccagatgcagcttgggagcgtgtttaagatgctcattcgcatcttaaatacagcgactacagagcagatgggatagggtattatttcttttttcgtctacatcaaatctacaaatcagtattattgtgaagcagcttatgttcctttcctttaaggagtccttcgtaaagttctcctacgattggattatcattagaacgttttatctgtgccgcatcgtcaatgcggtataatccctcaaatcttgctgctttggttcttgggccgattggtactggctgtccgccgcctgccatacagcctcttctacatgccatgacttctacaaagtcatattgtacttcaccactttttattttctggataagttcatctgcatttttcagtccactgactacagcaatcttaagctgtctgtctccatatggaataacagcttcttttatcccttttgttccacgaataccggtgaatttaatttcatttaaggcttccattccgctatctgctaccaagcgacgaaggactgcttctgttacaccaccagttacaccaaagataacaccggctcctgatgataatccaaatggcatatccattgcttcccatggcatctgtgtcagatcaattcctgcctcttttatcattcggataatttctgttgttgtcaatacgaaatctacatcctgctctccttctgtcttatgttccgggcggaggatttctgcttttttcgcagtacatggcataattgaaacaacaattgtttttctgctatcttctttattattccgcgcttcttcttttaataccgctccaaacatctgctgtggagaacggcaggtggagatattttcgcgtaactccggatatttctgctcgcaaaactttacccatgcagggcagcaagatgtgaacaatggtagtttttctcctgacttcactctttctaaaaattcttttgattcttccataatcgtcagatctgcaccgaaatccgtatcatatatttcatcaaatcccattcttcgaagtgctgccacgagctttccaagagagttttccccttttggtataccaaatttatcaccaacagctacacgaactgccggagcaatctgcacaacaactcttgtatttttatcagcaagtgcctcccataccggatgaatgttatgcttgatcgttatcgctcctgtcgggcatacaacacgacactgtccgcagccaacacaggctgtttctgccatttttcgatcaaatgccggcataacctgcatcttagagccgcgataggcaaaatctaaaatacctaatccctgaatctcctcacaagttcttacacagtctccgcagagaatacatttatttttatcaataactatacaatccgagctttcatcaatcggaatctgtggtttattattttcaaaacgtatgtaactgactccaagctgttttgcaagattttgtaatgtacagtctccatttttcttacaggttgtacactctctgcaatgtgcggaaagcatcagctctaaaatcatctttcgatgatgctgcagctttggtgtattcgtatagatcaccatgccgtctcttggcacctcggaacaagaagcaaagatcttccctctatcatcttctaccacacacatacggcaggcgccataagtagaaagttcagaatgataacagaatgtcggcagattaattcccgcttttctgataacagaaagcacatttttttcatcatcaaatgcaacttttctattattaattgtcatatatttcattgctttcccctcctatgcttctatatgaattgcgtggaatgcacaggcactctcacaggcaccacatttaatacagatactgtcatcaataacatacggctttttaatctgtccgctgattgcaccaaccggacagtttcttgcacattttgaacatcctttacaacgctccggactgataacaaaacgacgtaatgctgtacagttctttgctgcacattttttatcgacaacatgttcttcatattccttacggaaaagacgaagtgtactcataaccggaagtgctgcactctttccaagtccgcacagtgctgtatccgtaatcatagaagccagttcatcaagcagatttaagtcctcaagtgttccctttccagcaacaatcttttccagtatttcaagcattcgttttgttccctctcggcatggaacacatttaccacagctttcattctgtgtaaaattcataaagaaacgagcaacttctaccatacaggtcttatcgtccataactacaagacctcctgaaccaatcatcgctcccattttctttaaggaatcaaaatcaagacagacatctaaatgtggtgtgataagacatcctccggacggtcctccaatctggacagctttaaaatgtgcatctcctttgattccaccaccgatatcatagattacttcccgcaaagaagttcccatcggcacttcaatcaatcctgtattttttacacttcctgtaagagcaaatgctttcgttccgggactcttttctggtccgatactacgataccatgctgcacctttatcaataatcattgggacattggcaaaagtctcaacattatttaatacggttggctttgcgaacaatccctgttctaccgttcttggaggttttactcgcggcatccctctcttaccttcaatcgatgcagtaagcgcacttccttcaccacatacaaaagctcctgctcccctgttaatatgcaaatggaaagaaaaatctgttccaagaatgttctctccaaggagtccactttcctctgcctgtgaaattgccaggcgaagacggctgatcgcaagagggtattctgcacgtacataaatatatccttcctgtgcccctactgcataagctgcaatcagcataccttctatcattttatgagggtcaccttccatgatacttctgtccatgaatgctcccggatctccttcatcaccattacatacaatataacgtgttttctcctgctgtcttgcaacctgtttccacttatatcctgtctggaaaccaccgcctccacgacctcgcagatttgattctaaaatcgtctcaattacgtcatccggtgtttgttcaaacaatacctttgcaaatgcctggtatccgccaaccgcaatatattcttctatatgttctgcatcaatatgtccacaatttttaagtaccagacgggtctgtttcttataaaatggaatctcttcctgctttggatattcaacaccatcctgcttatataaaagatggtggataatattcccatgttttattgttctctcaaaaatctcttcgcagtcttctagttttacttttgtataaagaataccaagcggttcaattctcatcagcggtcccatctcacaaaagccatgacagccacttctcttgactgcaactggatgttcacttccatgtgcgatctccggtccaaattcaacatcaacatctttgcaatcctttgtaagttcacacattttctcataaatctcacctgaaccaccggctaaacatcctgttcctgcacaaatcaaaatacggcacttcgtggaagaaactttatctgctgccatctcacgaatcttgcttaactcttctctgttatgaatcctcatcccctattcctcctctcgaagcttctgaagtaactgtgcagcatcatccggtgtcattgacggatatactttatcattcaccgtcagtaccggagcaagaccacaggcaccaagacaggataccgtctccacagtaaataacatatcgtccgttgttaccttctcttttgaaagccctagttcactgtaaattctttccaggatcgtggtagacttacgcacatgacatgccgttccatcacagaccttaatcacatattttccctttggttcaaaagaaaaattctcataaaatgtagcaacactaaatgccttcgcctctgtaatcccaatcttatccgcaacataagataataattccggtggcagataccgatactcactctgaatatcctgtataatcggaataagagatgcttccaccgccccatgagactcaataatcgcatccgctttgtcatagtaacccttctctaacataagcttctcccttctttatatgcatatacacttttgaaaaaacaccacaaaagtaaacacaaacaactaaaaaatacacattactcacatttagatattgtgaacaatttttcaaacaaaacagttgttttatccccttttttgataaacattttatcattatactattattatataaaaaaacagagaaatttacaataactttttgatagttttttaacaattttattttactaataactctgttgtctaatctgttatataaaaaagctagccttttattttctgtaaaataatataaaagaccaggagcatcacaactgcaatactcctggtcttttatattactttactatattttttaagcagcaggacctacatcgatccactttttatctacccattctccttgagtataattccaacggcgtttctgtatccttccattatgctttctatatatatatccaatctggtctgcacaaggattaacctctccatcagaagcttccattacttcttcataaggtgcctctgcttcttctgcatgtaagcttgctactggacataccacacctaaactcataagaacagcacctgctgcgattgtttttttccatattgcctttttcatcgttctatctcctttttatgtatatgtaaattataaagttaccatatataaacataaaattggcaaagaacaggcaacatcaaaacattatctattcttcgtcatctaaattatctaaccttgactcaattaaattagaaagttcctctaaagattctgagcttatctcttcagaaacaaaggtattaaataaaccagaaaatactctcgtatttttcttcttctcctgctgtaactgtttcatagaatattcttctcttgtcatagatggctcaaacgttctggcataattctttgttgtcttcttaaatccggcaacctgaacgaacttcttctttaaaagagaatttaataataaatgcaccgagcttgacttccatgtccgatcatcggatacttctacaatttctgaagaagttagcgcttctccttcatcccacaacacttctagaatctgcatctcactgtttgtaattcttggaatcttcttacccataatatcatccttttcttctgttaattagtttgttttattatatcacaggatatattataaagaaatcaaattttagcagtgaaaaacctttattttcaaatatttattcttcaagctggtatttaatttattcttttataatcaaatatttatcataaagtcccttttccacatcttgttctgacaccttttcttctatacctcccacatgaaatatatacgtcccatcactctttttttccagataagtatcttttgcattaaatacctgatcttcttgattttccagtttttgaatttcttcatccgggctgtatgttggctgtaatataaaataataagaactaagcatccatacaaggcacccacaaatcacagccatattaatcttcttctgtaacttcaaattttctttcgcatctaatatgtaaaaaagtctttgtttgaatccttcttcactgtttatatcaacaaaattcaaagaattaaaattcaatttttttaatgaatgtttctctgcttccaatacataacatattgttttcaagtattctaatgcatatctcataggatagtctcggagcatggtcttatcacaccccatctctatcatcagtttaatatctttatgtaaaagtcgaaataacggattccaccaaaatataataatcatcagatatgcaaataataacttccaaggatcctttctcttccagtgtgtatattcatgcgttaaaatatatttgatttgtgtatctgtgcattctacttctgtcatataaatcgttggtttaaatatacctactaaaaatggtgtatccactaaatctgtatatcttatagaaataccactgtttggagcaatctcttctaaaatacgctctactcgtccatcccctttataacaggttctccgtaactttataagtagcccacctacagtaatgctgtaataaatcgaccaagcgataatccccagaacccatataccaaaaatagcccctaaagccagccttcttttatctgctcctaagtctgcatacgttttcatcagaaaagaaaacatatgtggatcacaaattaccttctgaaacactggtacttctattggtattaacattctgattgcacaaaatgcatataaaatacagataaaagtaaccccatacttcatcaggcaggctgttcttcttcttaaaacgactatcaggagaagcaacgggcagctaatcaaaactgtccatattaaagaatataatgatatcatacttgtcctccctatccccgttctgctttggtattgtaatcattatacactatataaaaataaaaagaaatagtttttgtttctttttaacatttatttttttcttttgtatttattctaatttttgtatcatttttagatacttttattataacgaacaaaagacaaataaaaaaaagcattatgcagttaccgtatatccacacagacaatgaatgcgatgcatttcatcgtgcaaggatacaaaacaggtttgcataatgccttttttgtttcacttatgaaattaatgggttttgtcgtatgatttcaaaaagtgagtcagacgatcgcaggactttgcccatacgacaagttcttccggacttaaagtttccatgatagcatctaacattttttcatggaattcttcatgatgtttataagcagcaattcctttttcaaggagatatacgttaacaacccgcctgtctttttcacttcgtgatctcgctacatagcctttatttacaagactgttcatagatgttgtgagagaacctactgtgatattcaaacgtttcgctaccacactcatgcgtgctccttcacccagaccgattgcttctatgatatgcatatcattattgcttatatccgaaaattcatctgtgatgatcgccttctcttctaattctaaaatctcgtggaaagtctttactaacattgtgtttattgtttctcttacattgttcattcctatattctcaccttatctaataccgtatcatttcttttacatctattataaacaatctttacagaaataatcaatgactttttttactgtttctattgtttttgcttcataagcacgtcctccgcagaataaaagggcctgatcgacttctcctttggctgcgtgaataagtgcctcggtgatacagtacggtgtttctgccggattgcaggtatggatacagcgaagacactttgttggtggaattctgccttcggcttttactttgtctaaaaaaacatttctgattgctcttcccggcatacctaccggactgtttacgataacgatatcttctttttttgcttgaatataggattgtttataacgttcatctgcgtcacattcttctgttgttacaaaacgggttgcaatctgcactccatctgcaccaagagtaaatgctctttcataatctgcatgttcataaatccctcccgccagaatgacagggatttttttctcatatttttcttcgtattttcttactacagtaataatttcttttacttcttcagcataaatatctggagtaagttctcctagctgttctttatggaaaccaagatgacctcctgccataggaccttcgatcacaataaaatctgctgtttttttatattttttatcccagaatttcaaaataacatgggcagattttctggttgatacaatgggagcgattgcaatatcactatcttttatataagcaggaagatcaaccggaagccctgctcctgatacgataaagtcagctcccgctgcaatcacttcacgtacatacgtttcataatcattcattgccaccatcaaattaaagccaatgactccttccggagaaatctttcttgctttatccatttctttatgaatcgcacgtttattcgcttctactggattctcataaaaatccggttcacgaaaaccaatctgcgcagcagatatcgttccggccccaccttcttttgcgacagctccggccagtccgccaagactgataccaacgcccataccaccctgtatgattgggacttttaattgttttttcccaatggaaaattgttcttttctcataagttacattctcctgtaaatcctgtctttatagtctcctgtaaaatacatctgcccttacatactgcgaaaacgttgatatctttgctccactcgttcttcttctgtcatactcttgctgttttttaaaaatatagaaatattttcttctagattatcaaatacgttaataatcgaatctaatgtgtaaccttctggttccggtatgattttttctacaaaaccagctttatataaatcataggaagtaagcttcatcgcttttgctgcacgagctgcctgactgccatctttccacaaaatagcggcgtatccttctggagaaagaatggaatagacagcattttcaagtatccagacttcatcagctacagccatggcaagtgcaccaccgcttccgccttctccaatcaggacagaaaggatcggggtttttaaggcagacatttcataaagatttcgggcaattgcctctccctgccctctttcttctgcttccataccacaaaatgctcccggtgtatcaacaaagcagataatcgggcgatggaacttttctgcctgcttcataagacgaagtgctttccgatacccttccggttccggcattccaaaattacgctcaatattttctgcggtactttttcctttcatctgtgcaataactgtaacaggctttccctggaagtaggcaatacctccgcagattgcggcatcatcgccaaagtttctgtcaccatggaactctataaattcttcaaataatccataaatataatcttctcctaccggacgatctttctcacgtgatgtcagtacacgctcccatgccgtctttttccctgcacgttttttctgtgccaaagagagtttttgtttacgtgactttcctgcatttttatttgaaacagcctgcacatcttctctctttgatgacggatttacagtatttaaatcagtgtttatttcagaaacggctcctgtattctttactattccagaatgctttgtcgtcaggcgatgcattgtaagtatttgttctaagaccgtcttcatatcttttctctctacgattttatcgataaatccatgttttaagagaaattctgaacgctgaaatccttttggaagcttcttatgaatcgtctgctcaatgacacgaggacctgcaaatccgataagtgcctttggttctgctaaaataatatctccaagcatggcaaaacttgcggtaactccacctgtggtcggatccgtcagcactgtgatgtataacaatcctgcatcgctgtgtctttttaatgctgccgaagtctttgccatctgcataagagaagtcattccttcctgcattcttgctcctccagaacaggtaaaaataataacaggaagtttttcttttgtggcacgttccacacctcttgcaatcttttcaccaacaacttcacccatacttgccataagaaaacgaccatccatcaccataagagcaacttcattttcaccaatacgcgcttttccggtaataactgcttcgtctaactttgtcttatcctgtaacgctttaattttgtcaggatagccaatcatatgcaatggattttctgtagaaagacccgtatcccactcttcaaaagaatctgcttctgttaaaaattcaattcgtttctgtgccggcattctaagatatcccccgcactttggacaaatataaagattctttttataatcttccgtaaagataccttttccgcatttattgcatcgttttaaaagtccttccggaacctctggctttatctgactggctgtttcttttacttccggttttatgacgggtgttttcttaaatatactttttaacttcattatttattctctcccatctcttcaagcaccttttctaagtactgaattgtaaaatcgccctcctgataatccggacgttccatgatttcatacagaaaatcaatattagttgtgattccttcaatgatcacttcacccaatgcccggtgcatctttgcaattgcttcttttcttgttgctgcaaatacaattaattttgtgatcatagaatcataataaggggatacttcgcagccgctgtaaatcgcactgtcaatacggacccctttacctcccggaagatacatatcggtaatccttcccggacatggacggaagttcttagacggatcttccgcattgatgcggcattcgatcgcatgacctgtaatctggatatcttcctgcttccattttagtttttctccatctgcaatacggatctgcgctttaatcaaatcaattccggttacccattctgtaacgggatgttctacctgaatacgggtattcatttccataaaataaaagctcttgtccttttcaagaaggaattcaatcgtaccggcattcttatagccggccgcctttgctgcaagaactgctgcttttcccattctttcacgaagttcctcatctacagcagcagaaggagattcctcaataactttctgatgatttctctggacagaacagtctcgttctccaagatgaatgacattaccgtaattatctgcaagaatctgaaactctatatgacgaggattctccacaaaatgctccagatacatactttcatcaccaaaggcaagtcctgactctttttgtgccatcaaaaaggcattttcaaattcctcttctgtataggcaacacgcattcctttgccaccgccaccaagaactgcctttacgataacggggaaccctatttcctttgcaatttctaatgcttcttttacatcggtaagtgccttctgacatcccggaataaccggcacgccggcatctaccatagtctgtcttgccactgccttatttccaagacgggcaataatatcggaatccggaccgataaaagtaatatggcaggcctcacatagctttgcaaactggctgttttctgataaaaaaccaaatcccggatgaatcgcatccgcaccggtaattatcgttgcactgataatctgctccatattcagatagctgtctttcgctgcagctggtccgatacagaccgcctcatcggcaagctgcgtgtgaagcgcctcccggtctgcttcggaatacactgcaacagtctcaatccccatctcccgacatgcacgaatgatgcggatggcaatctctcctctgtttgcaattaatattttccgaatcattataatctcctcttatctatccaaccataaaggttaattctgcttttacgaccacttttccatctacataagctgtagcttctcctacacccataggaccttttcgttttacaatctttgtttctaacttcaccttatctcctggaacaatttttcctttaaaacggcatttattgattccgccaaagtaggctgtttttcctttattttcttctaaagaaagaatcgcaacggctcctacctgcgctaatgcctctactgtaagaacccctggcataaccggttcctgtggaaaatgtccacgaaaaaagtcttcatgaaaagtaacacatttatatccgacagcactgacacccggttccatctcttcgatataatctactaaaagaaaaggatgtctatgtggtaagatctgttcaatttctttaattcctaatctcataatttttcctcaaatttgttcgttccataagaatgcttcttactgtatacggaataatggctgtccatactctacattgtcttcattttctacaagaatttctgtgacaactccatcaaattcgctctcaatctcattcataagcttcattgcttcaacaattgccagcgtctgtcccttctttacagtatcaccaacttttacaaaaggctgtgcgtcttcagatggcgctgcatagaatgtcccaactaatggagattttacaacattaccacctttttcttccgctatctgctctggctcctgctgtgcagaaactgcagtttctactgtattagcccctgctccggctgcttcctgcaaaacaagatttgatgccggcacaacaattttttcttctggctgtggacagctcatggcaatacggatatttccttctgtatattcaaaatttgtaagtcccgctttcgatacttcttttactaactctaaaatctgttgataatccatatctatctactcctcgtatttttttacaagaagagaagcattatgtcctccaaatccaagagagttggagattgctacattcacttcctgctctactgctccattaattacataatcaagatcacatccctcacctggattcgttgttcctaccgttgggtgaatatatccctcttcaatagacttcacacagacaatcaattccactgcgccggctgctccaagtaaatgaccaatcatagactttgtagagctcatttttacatgatctgcactggcaccaaaagctcttcttaccgctcttgtctcaaaaagatcattatgatgtgttcctgttccatgtgcattaatataatctacttcctctggttttacccctgcttcttccatggcaaattccatcgcttttgcagcaccacttccatcttctgcaggagaagtaatatgaaatgcatcacaggtagaaccatatccagctaattcagcaaggatctttgccccacgttttttcgcatgttctaactcttctaatacaacaacaccggcaccttctccgattacaaagccacttcttgcctcatcaaatggaagagaagcacgtaacggatcactttctccggaaagagcagtaagatttgtaaatcctgcaaccgcgactggtgtaatactgctttctgttcctccggcaagcatcacatccgcatctccgtactgaatcgcacgaagggcatctccaattgagttacttcctgttgcgcaggcagttacaacatcggtacattttcctttacatccaagatcaattgctacatttcccgctgccatattagatatcattaaaggaatcagcatcggacttactctctttggtccttttgtaataatcttctcatgttccttttccatgctggcaagaccaccgataccggaaccgataattacaccaacgcggtaaggatcttcttttgccatatcaagtcctgccatatcaaaagcttctctagaagctgctactgcatactgagaaaatacttccattcttcttgcagctttattatccagtctttcttttacattaaagtctttcacttccgctgcgatcttcactttataatcttcggtatcaaactttgtaatctctccgatacctaccttttcttctttaattccattccagaactcgtttactgtgtttccaatcggagtcacagcacccagtccagtaattacaactcttcttttcataaattttcctttcgtttattatgggtgtaactcattccctttgatggatgagttgattactttacatcaccattccaccatcaactaaaagtacctggcctgtaatgtaagctgccttgtcagatgctaaaaatactgctgcattcgcaatatcttccggctctgcaaaacggccgagtggaatttgtttctttgcattctcttttacttcatcagaaagtacatctgtcatctctgtctttacaaatcccggagcaatggcattacaggtaattcctcttgatgctaattcttttgccgcagatttggttaatccaatcattcctgctttggaagcacagtaatttgcctgaccggcatttccggcaacgccggaaacagaacttacattaatgattcttccatatctttgtttcatcatgcgacggctcgcaaaacgaatcatctgaaagcatccttttaagttcgtatcaataacatcatcaaaatctgcttcgctcatagccattaacagaccatcttttgtaattcctgcattgtttacaagaatatcaatgctgccaaatgttttggctgctgcctttactaaagcgttacattcttcaaaatctgctacattggcacgaaaaacttctgcttttcctcctgcctcttcaatctctttttttactaaaagcgctttttcttcatttccatggaaatgtactgctaccgatgccccttcttttgcaagggcaatggcgattgcttttccgattccgccggacgcgccggtcacaattgctgtttttccttctaataacatatctataactcctttatagcttccactgttttttctacttcttccattgttccgattcggaacatctttacgcttttatcaatctttctcataaaaccgctcaatgtctttcccggtccaatctctacgaaaatatccacaccgtctgctatcatggcacgtatactctgctcccataaaacggaggaataaacctgttcttttaataactctttcgttctttccgtatcttttataatacttgcatctacatttgtcacataaggaatcttcaattctcccaatgtcactttggaaagtgcctcataaagcttctctcctgcttcttttaagtaaatggaatggaatggtccgcttacgtttaatggaataacacgctttgcccctgcttcttttaatgcaggtgctgcatttgcaactgcttccttatcaccggtaattacaatctgtcccggacaattataattagcaacataaacgccttccatatatgcgattgcctcattcactgcctctccagacagtccaagtacggcggccatgcctccctttccgtctggtactgcattatgcataaggtttccacgaagccataccatcttaatagcatcctcaagctccataccacctgctgttgtaatcgcacaatattctccaagactaagtccggctgtcatatccggagtgagccctcttgccataatctcttttgtcattgccatacaggtagtaactaatgcagcctgtgtataatccgttctgtcaaggagttcattttcctcgaaacagatatgtttcatatcctgtcctaaaatctcacagctcttatcaaatacttcttttgccagtgggctttgttcataaaaatctttacccattcctgcgacctgtgctccttgtcccggataaagaaatgctattttactcatttactctacctcccgattttctctgcctgagtaagaataatctccttcatctcctgacagattccttcgataatttctttacaacttctgctgtcttttacaagacccgcaatctgacctgccatcacacttccatgaatgacatcgccatcaacaaccgctttcctgagaccacctaacgtaagcttttcaagttcttcaaaagaagctccttcctgctctaactttaagtactctcttgtctgctgatttcttaaacatcttaccggatgtccggttgttcttccagttaccttcgtatcaatatctcttgccttaataaccttattcttgtatgcatcacttacaatcgattcctttgatgctacaaaaatcgttcccatctggattgccttcgcaccaagcataaaagcggctgccattcctcttccatcggcaattccgcctgctgcgattaccggaatatttaccgcatcaacaacctgtggcaccaatgccattgttgttgtctctccaatatgcccaccagattctgtgccttctgctattaccgcatccgcacccgctttttccatcctctttgcaagtgcagtacttgctacaacaggaattacgcgtacacccgctttcttccaggcttccatatatttttccggattacctgcacctgtcgttactacttttacaccttcttttataagaagatcggcaatagcgtctgcttccggatttaataacatcagattgacaccaaatggcttatccgtcttttcctttaccttgtgaatctggtcttccacccaggaagccggtgccccaccggcaccaatgattccaagtcctccggcttcggaaacagcggcggcaagctcagctgttccaacccatgccataccgccctgaattaccggacactcaattccaagcaattctgtaatcactgttttcatccctgcacctctgcttatttatgttcttcaatataatttacaacatctccaactgttaccatcttctctaattcttctgtaggaatctctactccaaactcatcttcaagactcataaccatctcgaaaaggtcaagagaatctacctttaaatcttctttgaaagatgcttccattgtaatctgatcttcttcaattcctaatgagtccacgattaattctttaattttgtcaaacataatataaacctctcttttttctttttgtttttatatattcataactattcaaagtctaagttcaatggatatcttctatagttacctaagagttacctaagaagcgtattgaaactctgcatgcccccaaacagttatatgtaatccggaaattccggaaattaccttttatcattttattattcaaacttaccattccaaatacataccgccccatgtaagaccagcgccaaatcctgcgacaataatcttcattcctggctgtaactttccttcctgctttaattcatcaagcagtaccggtatgcttgcagaagacatgtttccgttctgcatcatatccatcggaaacttctcaattggctgctttaaccgctttgcaattgcttccacgattcttctgttcgcctgatgaagaacaaacagatcgatttcttctactgacttctctgccttttccaaaatctcatcaataacggctggaacctgtcggactgcaaacttataaatctccctgccgtccatagctacatagccttcaagcgatccatcttttctttctcctgtaggattcttacaggtgagtacctcacctctgcttccatcagaatgaagtacagaaggaatttcaatatttccttcttcctctgcactaatgacagcagcaccggcaccatcaccaaataaaatacatgtgcctctgtccttccagttaacaatattagacagacactctacaccgattaataatgctttcttcgaaagccctgccttaatctgtccggctgccatctggtatgccactataaatcctgaacatgctgcattcaaatcaaatgctgccgcattcaccgcaccaagttccttctgaacactacatgccgtacatggcaaaagctgttcggaggaaacgctcgatacaataagaagatcaatctcttctgctgttattccggcatcttctaacgctttctctgctgccacagccgccatggaaactgctgtctctttcccgacaatatgccggctcttaattccggtacgactttgaatccattcatcgttcgtatctaccaaccgagaaattgcagcattatcaagtactttctcaggaaggcaggagcctgtcccttttattttgacaaacatcactctctcctttttttgtgtgataccttcccatactcttgaaaaagcatcttcttgttaaatcatcacaggcatctgaaccacctcacatctgatacaaatgattcagtgcccaatattttgattaccaaatcttattgttttgaaatattattattttgatttcatattatttttaaataaaatagttttaataccaaaataaacatttacaaatataccatagctctcagaaatgtcaagtactttttttaatgcatttttttgaattgtaagataaaaatggagaattatctcccatctgatataaaactactgctaaatgtttctaaattatatgttttcttattttcttccatatgctatactctcttacaaatgtattctcaaagtttttgctgcacatgctaaagcaggcgcaaaaagattttaagaatacatccaaatagaaaggagaaagaaatttccatgaaaaagaaacaaaaacaacattatacagggaagaaatggattgcagcgcttgtcgttattgttctcatttttgcagcaatctattattatattgctcttcctgcaataaacattcacaatccggagctttggaagtttgtcttgtttgtccttgtcattgcattcgcactgtatgcacttcccaaaacgacttttacaggtgatcgcagacatcccgtaaatttcagtggcagctataaaacaaagacttttaaacttttgtccgctcttatcgttatcattgctgccgcctactttgttggcacacttttatcttctccaattattaatgcttccaaataccagaagctcatgaaagtagaaaaaagtaaatttacaaaagatattgatcagatttcttacgaccagattcctctgcttgacaaatcttccgcagaaattcttggtgcccgtaagatgggtagtcttgtagaccttgcatctcaatttgaagttgctgatgaatacagccagatcaattacaaaaataacccggttcgtgtcactccgcttcgctatgctgatcttatcaaatggtttacaaataaaaaagcgggcatacctgcttatattaaaatcgacatggcaacacagcagacggaacttgttcgtctgaaggaaggaatgaaatacaccccatacgaccattttggccgctatctttaccgtcatctccgctttaaatatcctacctatatgtttgatgacattaactttgaaattaacgaagaaggcgttccttattgggtatgtagtgtaaagaagtacaatattggtctttttggcggacagactgtcggacgtgtcgtattatgtaatgctatcacaggagaatgtaaagattacgatgtaaaagacacccctaaatggattgatcgtgtctactctgctgatttacttgtaagcctttatcaatatcatggcacattaaaacatggatttattaacagtattcttggtcaaaaagattgtctaacaactacaaacggctataattaccttgctatcaacgatgatgtatgggtatataccggtgttacttccatcacaagtgaccagtcaaacgttggttttgttctcatgaaccagcgtactatggagacaaaatactacgagattgaaggggcaatcgaagattctgccatgacttccgcagagggaaaagttcagaacttaggttacaaggcaactttcccacttcttttaaacattgatgcagagccgacttatttcatggcattaaaagatgcctcaggacttgtcaaaaaatacgctatggtaaatgtacacaattaccagattgtagcaaccggcgataccgtaaatgattgtgaggcatcttaccgttctcttattcaatcaaacggtatcagtccagatgaaaaaactggagaaacttctcaaaaaacaataaccggaacgattaaaaagattgcacaggcagtcattgatggaacttctcattattacatcgttctaaatgaatctgacctgatttatgacgtagatatatctaagcatttagatacgatattgttagaagcagggaataaagtaaccataaaatatacggaaggaactcctgcaacagtaatcgaaatacaaaaacagtaattagacagactaaacaaacaaaaaccagaaatagtatatataaaactatactatttctggttttctttttaagagaacctcaatgcctctattggtttctttttcgctgctttatttgctggataaattccaaatctattacttccactctattttcaatattggaaatcaatatttaagatagatttccagttttcttttaactttggataaagtgcatcgaattcacgatatactttatcataaataaatgcaaattcttcgtctggtttataaacttcgtctcgcattttaataatcttatcacaggcatcaaccacacttgggtatgctccggtacccactgctgctaaaattgccacaccaagggctgcgctattttcagaattcatatctggaagtgttactggcatattatagatatctgccataagctgtctccagaatggactctttgaaccaccaccgcacatccgcattgtttccggacgtacaccacaattacgaattccggtaagaatatctcgtaatgcatacgttgttccttccattacggctcttgtcatatctgctcttgtatgaattgcagcaagtcctacgaaagaacctcgacagttcaagttaaaatgaggagactgttctccatttaaatatggcagataaattaaacggtttgcacttgggttagaagatgcagcatctttgttaatctgctcatattctaaatcatctggatagaaattatttctccaccatttaagagaagctccacaggaatttacacttcccataaaatgccatgctcccggaaccggcatacagaatgtatatacagatttattaatatcaagtaccggttcctcggaaaaagcaaatactgttccactcgttccaattgttgtcatagctcgtcccggtgctacaacacctgttcctacacctccggcagagttatcacttgcacctccgactacggcacattttgatgtgattcccattaactttgcaacttctggaagaacatatcccgtaatttcctgggattcgtatactttaccaagcattgcctcgttaagattcatggcagtcataatttcatcagaccattttctatttggaatatcaagaatctgtgttgcagaagcatcggacacttctgtcgcatattcgccagtcagacgataacgcagataatcttttggcaataaaatgtgttctactttttcataaatctgtggctgattttcttttacccactgaatctttgctgcagtaagacccggtcttgcaggagtaagagaatatttcataaataaatcgtctcctacgatatgtcgtacatgctcacaagattcagaagttcttccatcattccataagattgcacgacgaagaatctctccattcttgtcaagcataactgctcccatcatctgccctgaaattccaagacccattacctgttccggtgcaatacctgactgatccataaccgctttaactgtctttaatgccgcctgataccaatcttccggattctgctcagaccagccgttatggggctgatacaatggatattccacagcagaagctgcaatttccaatccatttacatcaaataatactgtctttaaactacctgttcctaaatctaaccctaaataatatgtcattattttcccccgatcttttttatgtactttcagaacttttctgtacttgctttttcaaaaaattcttttcaaattgttacatatgtctttcaaacttcttccatggaatattaagtgttgcatgttcattcagcaagccgtctacatgcattaataatgggaaatcatcaatacttactttacctgcttttgccaacgcctttactgcacgagcagttcttgttgcgataacaactgcctccaatgtctgaccctgtaactgttctaatgtttcttcaatagtgtaaccttttccaagaagtaaacctactgttctgcttcgtccggctgatacagtaacgtctaagtctccggctgcaaacataatattatctacaccaccgcctacaattcttaatagttctaacatttcctttacactttcctggaaaagtgcagatttcatattattatgattgattccgtcatcaccaagtttctctttaattccaattgccaatgctgtgccaagtgcatatccattcttcaacgctaccgcacattctaagccgacaacatcttttgtcaggctgataatgtagtaatctgttgaaaacaaactgcgaatccattctaatgtttcgaaatcaggtccacaatatgccacaaaagatggatcatgatcagataaatctcttgccgtacaaggaccacctatagcatataatcttaacttacttccttctggaagtttttcctgccagtattccggataggtctgcatcgttccatcttcataatcaagcattccttttgttacagaaattaatggaatactttcgtcaagaatcggaagaatctcatctgcaaaccactctacaccaaagctagatataccacatacaatcaaatctgctcccttaattgcttccttaacatccgcacatttaatatagttaattccatcgtgtaaagttcttcttaagttgacatggtaattatcctcacgaagtctgtcaataaccgcatcatctaaaggacttcctactaaacgtacctcatgtccattctcaaaaagtggaaaagtaagcgcagaagccatctgtcctgctccgatcaatgttacaacactcataattgtacctcctagatattactcgaatcccgtctgtatccttagattcctactattctgcatctccagtcgtatcgtttacaaaacctgaaaagcaaccctttagattattgaaatatttctcattattaaggagaatcatttcatttgttgtttatagtatagattttattgtgagaaaagtcaatcggcatatgaaacaaatttcacgcataaaaattgttcataatgaataagtgcatattctcgtaaattatagccgcaaatttccttttatgatatacttattactattcaagaatatctcgacactcttgctgcgagatgtgcgttattattttacaaaggcttttatgaattacgaatctttttacagagaggattaataaaaatatggatacaaataaaatcacacagatgatccgcattgcaaaaatgcattatgaattaaaccgtacacagcttgagattgcaaaaaaagaagggataagcaaggccactgtcagcaggattttaaaatctgctatggataagggtattatcgaggttcgcattaaagattcgattttgaatgatacagcactcgaaaaagacctgatagatgcttatccgattaaacgtgctgttattgttcctgatctggtagaaaatgagcagattcttctccaggatgtctgtgctgctttgatagatgatcttccaagatatgtaaaaaacgatagtgtgattggcgttttttatgggcatacattaactgcccttacacgtcagcttcctaaaatcaagcgtaagggagtatctgtaatccagcttgccggcggattttcgcgagccgtttatgagtcaaattctctatctatccttcgaagttttgccgattgctttggtggaactgcttatcagattcctgctcctgcaatggtagaaaaaccatttattgtggaagctctaaagcaggactcacagattgcgaaagtttgtgatatggcagaaatatgcgaaacagctattttttctgtcggcaacttagagcgcccttctattctctatgaaatgggactgattacatcaatcgaatatcaggatatgatacaccgcggagcaatcggtgactgctgctctcacttcttaaataaaaatggagatgtatttgacgaaacaatggatgcacgtgttgtaggaccttcacttgaaaccatcaagaaaatccctaacaaaatgcttgttgtttctggcaaaaagaaagcggcggtcatccatgctgccctaaaaggcgggcttgcagacagtctttatattgatgcccctaccgcagaagaattattaaaaaaacaattttaatttaagaatgtctcagaagagatgggagttatctttaacagacaaaaaccagagattcgctatagcacaaatctctggttttttatttttatctcctaatggaaatccgtataattattcttcttcccagttatgatatactgcctgtacatcatcgtcttcatcaagtaagtctaatgtacggttaagattcttaatatcttctgggtctgtcaatgttacgtagttgtccggaatcattgttacttctgcggatgccattggtacgccttctttttcaagtgcttctcttacttcaccaaatacatctggatctgtagtgatttcgtagctgtcatcttcttctacgaagtcttctgcacctgcatctaatgcaaccatcatgaattcatctggatctgtttcatactcttctttcgatacgataatctgtccttttttctggaacatgaaagatacacaaccagatgtaccgatatttccacgacctttagagaatgcggaacgaacgttagctgcagtacgattcttattatctgttaatgtttctacgataatcgcaataccgttaggaccgtatccttcgtatgtattctgtacatagtttacggagtttgcgtctccggcagctttcttaatacctctttcaatcgtatcattaggcatattgtttgattttgctttagcgattacatctcgaagcttactgttattagcagggtctggaccgccttcttttactgctactgcaatttcacgaccgattacggtaaaaattttaccttttgcagcatcatttttctcttttttgtgtttaatgttcgcaaacttggaatgtcctgacattttatcttctccttacttttttataatatttacgtactcaaaactattcaataccaaaaatcaaacgcatctataatgctttgaatagttgcaaatactctttataggcataacttttctaagtttatcaccgttttatcatgtagtcaagtagttactctttgataattccggactctttgatgctatcaattgctttttttatttctgacgggggtagtacaagagcaaaacgaacatatccttctcccagacttccaaagctgcttcccggtgtacagattactccggtcttttccatgagttccataacaaattcattggaattagcataaccttttggtaacggtccccatgcaaacattgttccttcactgtctggaatgttccagccaatttcacgaagtcctccacataaagcatctcgtctttcctgatatgccgcacattgttcttttactgctgtatcatcagaataaagtgctgctacggcacctgcctgtactggaaggaaaattccataatctatctgggaacggaaacgtttaaacacttcaataacttttgcattaccaattacaaaagacattcttgcacctgtataattatagcttttagacagagaatagaattccacaccaacttcttttgctcccggaaatgagaggaacgactttccttctttcccgtcgtatataatgtccgagtaggcattatcatgaataattaatatattattttcttttgcaaatgcaatcaatttctcataaaattcatctggtgccgttttacaaatagggttcgctggataagatacgaccataattttggctgcttcttttacatcctgcggaatagcatcaaaatccggaagataattattttcctctgttaatggataaaaccactggttactctgtgcaataaatgctcccgttgaaaaaataggataacccggattcggtaaaagtacgatatctcccggattaatcagcgggagaaaaatatgtgccattccttcctgggatccataaactgacatgatttcgtttttggcaatatctgtttgatatctttttttataacgatgaacgaccgcttctaaaagttcttctgtttctcctaaagaataatgataattttccggatgaaggcaagcttctgacactgctttcattacacattccggtgtttcaaaatccggtgtacctacagaaaaattataaatcttttttccctgtttttctaattctttcttttttttatctaaaatctgaaaaattcctgcttcaaaatttttcattttttctgctggttcaaaattcattattgttctcctttgtattatcaatctacttaaaattcaagaatgtcagaacattcttaaattacctttatgtaatcagttctaaactgatttttaaggcatagtttactctttttagtgtatctgtgtcaagatggcatactcgttcttttaaccgctgtttatcaatggtacgtatctgttctaatagtacgacagagtcttttgtaatatcacattctgctgcagaaagctccacatgagttggcagctttgccttattcatccggcttgtgatcgctgcacaaattactgtaggactatgacgatttcccgcgtcattttgaataataagaaccgggcgaacaccaccctgctctgagcctacaaccggacgaagatccgcataataaatatctccccgttttatcatcattttcactcactccattttacttttctttctaaatgaagtatttccagtaaacatcatgagtattctgatgattttttctttttgatctttcccctgaaattttttatttcaaaactttttccagataattcggcaaatctcctgcaagtacactataatatcccttttcttttgaggcggcatctcccgcaagtccatggcaatacactcctaatcgtgctgcagttaacaaactaagcccacctgccagaaaaccacaaattattccggttaaaacatcaccgcttccgcctgttgccatcccattatttccactcatattaatatatgaaggagcatttccatcagatacaattgtccttgcatcttttaagacgattatatgatcttgatctgccatcttcatcgctgcttttggcagattactctgaatctccgttatttcttcttctatcagcctagacatctcttttagatgtggcgttaatatgattccactcttatattcatagaataattgttttatctctctatcatttttcaataaaacagccagattatttaatccatccgcatcgatcacaagcgggacttttcccaatgcaagaacctgctttaataatcttctggcaaatatactctgtccaattcctggaccaatgccgataactgatgcccaggaaatcgcttctggcaaaatctctcccgccttttcttctgaatcatatgttgtaagaatagcctccggaagcttttcttgtaaaattacccggttttcttcacaggaaaaaatccgtaccagcccacttccgcttttataagctgccattccgcttaaaactgctgctccagccatgtttttcgccccagcaatcaataataccttcccataatttcccttattcgtccaggcttttcgttctggcagcagagcaagatcctcttttacaaaagaaatcatcttcggagcaattttttctaccgctttgtttgggaatccaatttcctttacaataacttctccactgatatccgctcccggatacaggagcagcccagcttttagtagtccaaacgtaaccgtcaaatccgcgcaaaaagctataccaagaatctgtcctgttgaagcatctacacccgatggcacatcaaccgctacttttaacgctttcttctgattcatcctctcgatcacttctctgtgctgtccagctacttctctttttaatccgacaccgaaaacagcatcgacgatcacatcatattcttcttctggaaactccatcaaaaactgtgcttccatctgctctaaaactttcttctgaatctgatgggaatctgaatcatgtggaattgctccgatttcataaaaatcaacattgtatccatcttctaataaaagacgcccaagcgccagaccatctccaccattattgcccttttccgtaacaataagtacacgactctttgtcggtactctctctaaaaagacttcttctaaagcaagcgccgccttttccattaaaacaataccaggaatccccatcgtatttatactatacgcatcaatctgctgcatttcctctctcgaagcaacgtaacgcatctttaaacctcctgtttcttaaaaaatgtaccccagagtcgttgctgtacttactgttgtaagaagattccgagcatacatacgtaatttgcgattgagcagtcagcaaaaaaagatgaaaaacaatgctttctatcacacagcttctcatctctttactttcttttacaatatatactttgtagtaactattctattgattctgactgtgaattctataagacaatgtcataatactctctgcaagatgtacattctcaaccagaatatcttctgaaaaatgtaaatctactggtgcaaagttccataatgccttaattcctaaatcaactaacttttctgcaacctttactgcttttgacttcggtaacgttaatgcagcaatcattacctcatgctcttttaaaaatgtttccagcatgtcgatatcatatacttccacaccccgcactgtcataccaattaatcttggattcacatcgaaaagtccgataattttaaatccattactgtcaaaatcctggttattcgccaacgcctgaccaagattacccgcacctacgataatgatgttatttgttctatccagacccagaatcttacccatctcattataaagatactctacattataaccatatccctgctgaccaaacccaccaaaattatttaaatcctgacgaatctgagaagcagtgacgttcattctctgactcagttccttcgaagaaatacgaacaacatcattcttcagtaaatctccaagataccgatagtaccggggtaatctttttatcactgccggagaaattgacttttcattccctgtttttacaactgctttattgtctggcataagatcctccctttgataaaaaattcccattctcaagttctacttaatcaattatatacaaaaatagttttaatgtcaaataggattgttaaaaattccaacacttatttacttattatttctttcatgataaaatacatcagaaatatttctactatataataatataatcaatttggaggttattatgattttagcctgtcagaaaatcgaaaaagcattcggaggaaaatccgtattaaataatgttaattttttaattaatgaaggggaaaaggctgctgtaatcggtatcaacggtgccggtaaaacaactcttttcaaaattatcactggagaatatgaggcagatcatggggaggttatctttcagaaaggctctacttatggctacttatcccaggtcattgacgtaagttctcatcgcagcatttatgaagaaatgcttgatgcaaaaaaagatatcatcgaaatggaaaagaaaatacgtcaattagaaaaagatatcagcactttgtccggtgaagcattagaaagagcaatggaaagttattcccgtcttactgaccgctttgagaaggcaaacggttatgcctggaaaagcgaaattaccggtgtattaaaaggtctcggctttgatgaaagccagtttgacacactgattcacacactttccggaggacagaagacccgcgtagcactcagccgtattcttctgatgcacccggatctcattttacttgatgagccgactaaccaccttgatatggaatccattcgctggttagaaactttcctttctaactaccggggtgcggtgcttattgtttcccatgaccgctattttcttgataaagttgttgataaagtaatcgagatcgagcttggaaacagtcaggtatttaacggcaactacagtgcttac

SEQ ID NO: 431 - DNA, 30936 bp, Eubacterium hallii
cctcaagatgagatatccagactcgaaagagtgagagaccccttagagacgatgaggtagatagggcagggatggaagcacagtgatgtgtggagttgactgttactaatcggtcgatagcttgaccttagaaagttattggaatagaaaaaagatagtttgtgtgtagttttgaaggtacatacctttttggcccggtggctcagctggttagagcgccgccctgtcacggcggaggtcgtgggttcgaatcccatccgggtcgcttatctataaagatataatttagtaatatgggatcttagctcagctgggagagcatctgccttacaagcagagggtcataggttcgagtcctataggtcccattttgccgatgtggctcaattggcagagcagctgatttgtaatcagcaggttaacggttcgagtccgttcatcggctttgttatgattatcaaagcattttcataattgaatatgggtggattcccgagtggccaaaggggacagactgtaaatctgctgcaaattgcttcggtggttcgaatccacctccgcccatttaaaaattaataattatctattatcgcggggtagagcagtctggtagctcgtcgggctcataacccggaggtcgttggttcaaatccttcccccgcaactcatgcccagatagctcagttggtagagcagaggactgaaaatcctcgtgtcactggttcgattccggttctgggcatatgggatattagctcagttggtagagcacttgacttttaatcaagttgtccggggttcgaatccccgatgtctcatgaaagctcagtaaatattttatttactgagctattttttttgtcttaagaattagaatataaggatatagaatagaaaagaaacattaagaagtaaagagagatatgaatacaccaatatataataaattaaaagagctagactcagaaaaaagaataccttttcatatgccgggccacaaaagaacagattttggggctttttttggtatagaaaaaatggatattacagaaattacagattatgataatcttcatgaaccagaaggtatcatcagagaatctatggatttagtaaaagatatatttaaaagtacagaatcctggtatcttgttggaggtagtactcttgggattcttgtatctatttcttcggtatgtaagccgggagataagattttaataggcagaaactgccataaagcggtttataactgtattcgacttttacagttagaggccgtttattgttatgcagacatttcacaaaaatatgatgtatgtgttgacatgaaacctgagatggtagaaaagaaattaaaggagaatccggaaataaaagcggttgtacttacttcacctacttatgaaggggttgtaagcgatattaaaggaattaaaaagactattcaaccatatgggattccattaattgtagatgaagcacatggagcacattttgtttttgataaatattttcctgacagcgcaacaaaacagggggctgatctggtgattcaaagtacgcataaaacattgccttcgtttacacagacagcagtattgcatctttgttcggatttgataaaaaaagagcaggtggaggaaatgatagatatttatgagacatcgagtccttcgtatcttttaatggcatctgcagagtatggaattatgtgtatgaaagaggagaaagaacaacttgctcaatatgtggataaccttaaaattttccgaaagaaatgtgaacaacttcaaaaaatagaattacttgatcaaaaaaagttaggatgttttgcctacgataatggaaagttggtattttccgtaaaaaattgtgggattaatggaaaagaattatttcatttattatatgataaatatcatattgaattggagatggagaatcttacttatggaatcgccatgacatctgtatgtgatacaaaagaaaattttgagaagttgtgggctgcgatttctgaaatagacaaaatgtgtgactttagagaaaaacaaaatgaactggaaaagaaaacccagccagaaagtttgataggagaaaattttgtaacaaaaaatttggagttcgtatatccgccgaaaatgatggaatcatggcaatgtcggggacggcaggtagaaaatataaagttatctgatgcagtaggaagaatttccgggaaatatgtgatgatttatccgccaggagtgccaatattagttccaggagaaaaaatactgaaagaaacagtggaaaatatcagtcaatatttatataatggatataatgtacttggattatctaaagaggatcaggtgcaggtacttctgaagggagattttattagatgaagggattatttattgtgatggagggtccggatggttccggaaagactacacaaataaatttgttagagcaatatttaaaagaagcaggatatgaatgtctgattacaagagagccgggaggaacggtaataggagaagaggtaagggagttaattcttaatccggaatataaggagatgtctccggttacagagatgcttctttatgcggcatctagggcacagcttgtacatgaggtaatcggaccggctttagaagcaggaagaattgttataagtgatcgttttgtagattcatcgattgtttatcagggaattgcaagaaatcttgggatttctacggtagcagctgtaaatgcaccaggaatcggtatttatcgtccagatgggattttctttattgatttatcagaggcagaaggaattcgccgcaagaagaatcagaagaagcttgaccgtatggagcaggagagtatagattttcatcatctggtttcagaaggatatcgtaaagtacttgcagaacgaccggaagttattaaaattgatggtggaaaagacattgatgttatccagaaaaagattcgcaatcatgtggatgaattattaaagaaaaagaatcgttaaacaacagaaaccgatagagtcgttattagataagtgattaccaggaaagatttttgaggaaagatcatggctgatataaatgatattttaggaaatgaaagagtgaaagaacattttattgctgctgtgcatcataaaaagatttcccatgcctatattattgaaggggataagggaagtggaaagaagatgcttgcggccgtcttttctaaaatattgcaatgtgaaacaaggcagaaaacagaggaagaaagagcttgtaatcaatgcgaatcatgtatacagatggaaaataaagaccatccagatgtgatatgggtttctcacgaaaaagcgggagtgaccagtgttggagaaataagagaacaagtcgtaaatactgtagatattatgccgtataaaggtccatataaaatttatataatagatgaagcagagaagatgaatgtggcagcgcagaatgcgattttaaagacgattgaagaaccaccggaatatgcgattatttttttattgacaacaaatcgtggagcctttttagataccatactttcaagatgtattcttcttgaaacgaagccggtatcgggaaaaatgattgaaagatatttaggagagcgatacaaaattccggaagaggaagcagaatttgcagcaggattttctcttggaaatataggaaaggccgaatctatcatattgtctgaagaatttcgggaattaaaagatttgacgttagatattttacgatatattcatgagattgaaagttacgaaattgcggataaagtaaaagaatataaaaaatacaaagctcggattgatgatttttttgatatctttcttatgtggtttcgagacattttattattaaaagcggatacgtcaccgaataaagatatagccagaaggaagattatttttaaaaatgagtatatatctttgagaaaacaggcagacaaattaaagatggattcgatcgactatattattaatagaataaatcgtgcacgaatccggataaaatcaaacgtaaattttgatgcaacgctggaattgcttattgtagaagcaaggagagaattttaattcaaaaaggcttttgcattcttgtatcaaagaggtcaaatagaagtttaaaatagagaagtataaaataaagaagtataagatagagaaatataagatacagaataggaggttataatggccaaagtaataggagttcgttttagagacaatggtaagatatattatttttcttctgaacagtttgaggtagaagtaggacagaatgttatcgtagaaactgcacgtggtgtggagtatggaagagtggtacttggaaatcgtgaaattcatgatgagaagattatttctacgctaaaaccagttattcgaattgcaacagaagatgatgataaaatacaggcaaataataagatcaagagtaaagaagcatacggtatttgtcttgaaaagattaaaaaacatgagttggaaatgaagcttattgactgtgaatacacatttgataataataaagtattattttatttcactgcagatggaagaattgattttcgtgagcttgttaaagatctggcttctgtctttaagacaagaatcgagttaagacagattggtgtaagggatgagacaaagattaaaggtggaattggaatttgtggaagaagtctttgctgtaatacatttttatctgagtttgttccggtatcgatcaagatggcaaaagagcagaatctttctttgaatccaacaaagatttccggagtttgcggaagacttatgtgctgcctgaaaaatgagcaggatacgtatgagtatcttaacagcaagcttccgaatgtaggagatgaagtgaaaacgtcaacgggtgtcaagggaattgttcaggaagtcagtgtattgcgacagagagtgaaacttttggtaacagatgaaaaaggagaaaaggaacttatagattataaagtagatgatcttgttttccgtcctcgcaagcgcagagaaaaagtaaaaatggatgatgaacttaaaaagttagaagcgatggagaagaaggaaagaaagtcaaaattataaggaaaataaaataggatatttatatggaattagtacaagtaaaagaaaaggagcgcattgatgaccttcaaataaaagagtatcgtattatccagaagaccgatggcttttgttttggcattgatgcagtacttctttctgattatgccaaagtaaaaaagaatagtcgaggaatcgatctttgtagtggtacggggattgttccaatactcatggatgcaaagtacccgattgctcatgtagaaggtttagaatatcaggaagactatgcggagatggcagagcgttctgttcatatgaatggacagagtgaaagggtatacatcgcccatggagatgtccgtcaggtaaaagaaaagtataaaagagaaagctttgactgggtaacctgtaatcctccttatatgacaggtgcgcatggacttaagaatcccgattacggaaaggcaatcgcacgacatgagattacctgttctcttgaagatgtagtacaggctgcgaagtggctattaaagccgggaggacatttttacatggtacacaggccatttcgactggcagaaatcatttatacattaaagcaatataaattagaacctaaaagaatgagacttgtacatccttacgttgataaagagccgaatatggttcttattgattgtgcaaaaggcggaaatccgagaattacggtggattcaccattgattgtatataataaagatggttcttataccgatgagatctatcagatatatggagagatgaagaattaaaatggcaggaacattatatttatgtgctacaccgattggtaatcttgaagatatgacctttcgggcggtacgaattttaaaagaagtggatctgatagcggcagaagatacaagaaacagtataaagcttttaaatcattttgagataaagacaaagatgaccagctatcatgaatataacaaagttgataaagcagtttatcttgtaaataagttaaaagagggattaaatatcgcagtaattacggatgcaggaacaccgggaatctcagatccgggagaagaattagtaagacagtgctatgaagcaggaattacagtgacttctcttcctggtgcctgcgcctgtattacagcgcttaccatgtctgggcagccaacaagaagatttgcatttgaagcatttttaccgtatgacaagaaggaaagaacacagattttagagaatcttcgtaatgagacaagaacaattattatttacgaagcgccgcatcatttaaagaagactttgaaagagtgtagggaatatcttggtaaccgaaatatgacgatatgtaaagaactgacgaagcgatatgagcagaagcgcaagtcaactctcgatgaaatgattgcttattatgaggagaacgagccaagaggggagtatgttttaatctttgagggaaagagtttacaggaactgaaagaggaaaaacaacaggagtggaatcagcttactgtgcaggaacatatggatcattatcttgaaaaagggatggataaaaagagtgcgatgaaacaggtagcaaaagaccgcggagtaagtaaaagggatatttatcaggaattgttaaaagagtaatccttttttctaaaaattaaataaatgaattcttaagaattctatagttgagaaatgttatcaactgtagaattgacagggagtataaaaacaggtaatcttttaaataaactaactgatgttagaattaagtaacataaattagttttaaatggcaacctgttttttttattaagtttatttgagagagagaaagggagagaaacaaatgagaaaaattagttcagtcattatggcatgtgctatgtgcctgtcaatggcagtagtgggaacagttgcaccacaggtagcggtacaggctgaggagacagcagcggtagaattgaaggaagcaccaacggaaactccaacacttgataaagattttggttatgaatggtatcttattcaatatcctgaatatactgcaaattcagaaaatacaaaaagttggatggaaaagattacatctattaaagtaaatgatgcagaaccttatactaaagtagataataaatttcttatgaaagaagatacatttagagcatatgtgaacatggttaatataacaataggaaataaggaatttacaaaagatactaacaaagttgttatttctgcagaaggatataaagacttagtattagaagtaggtaaagattataaaacagttgccatccacacaaaacatacgggcggaacagctacttgtacgaagaaagcagtctgcgaattctgtggagaagagtacggtgagtacgcatctcataactatggagataaatatgagtctgacggaacttatcactggaagaaatgtcagaatgaaggttgtgatgctacgactgaaaaagaagcacataaaggtggcgaagctacaacaacaaagagagcagtctgtgaagtatgtggagcagaatatggagatttaaagcaagaagatcctaagccagcagacaaaacaacagaaggtaaaaaagatgatacaaaaccagcagaaaagccagataagaaaactgtaaaagcaaaaaaagttgttgttaacaaaaagcgtattgtgttaaagaaaggcaaaaaagttaaacttaaagcaaaattaaaaccagccaatgcgacagaaaaagttacctttaagtctactaacaagaaggttgccaaagtaacaaagaagggtgttgtaaaagctgttaaaaaaggtaaatgcaagattactgttaagacagcaagtggaaagaaagtagttgttaaagtaactgtaaaataggagaaaccggatatgaataggaaggttagaaatttattagccagtgtagttttgggagtgtgtttacttacattatcctttattccttcatttgcggcaaactctgcaaattctgccagtgtcggcaatgtagaagcaatgaaagaaaatgtagtttatgattttcaaagtctttcttttgcggatgcacctgactatgtcaatggaataaaaagtgtttctgtaaataaaacaaagtgggaagaagcaagttctcgtttatctttaatgagacgagaagcatactacagaaatacagatgaaaataaactttattttgatggttcttctgatggtatgttaaagagtggaaatattctcacgattgagagtgaaggatatgaaacgctgtacttacgtgtgataaaggcaacagcagatacatttactgttaaaaagatagattcagatgcagagactccttcaggaccttctgatggaattaatacgcttcatgtaagaatacgaggaagctttgaaagtgctttagaaggacagaagaaatatgatgcaatcagtggagcttctacttctgttacaacaaataaaaatagtgatgtgattgttgaagcagtagttcttcctgatggacaggagccgaagaacagcgactggaagccgttaagtgaagtaatcacagtaaataaaaatagaacaaagataaatattgatacagaagcctgtggaatggaaggagtttattctgtccacgacagttctctttctttatcaggggaaccattaaaagccggttcttatccaattagtgtaacagtaacggatgagagcggtcgtactgcgacaagtaatgagctgaattttaaagtttatactcgtacagaagtacttgcaaagcagcttaaacttgagaattgtaagcagacagcggatggaaagtatatgtatgatatggagccatgggcaatcgcttcttttggtggagagaacgaaactgttacggtaccaaaggatattaaagcatggtacggttctcatacaagtggaacttatggagaacttggttatgctgtagatggtagtccagtacagacattgattgttccagatggctgtaatcttactcttgtaaatatgaaagttttcagcagcgtaaatattgttgtagagaatggcggaaagcttgttcttcgtgattcttctattcatggaaatattgaagtgaaaaatggcggtaagttctcatcaaactatgatgattatggcagtcagtttctcacaggttcttcaattaatggacagctgattttaaatgatggagcaattttagaaaattcatctatttattctaacaccaattttatatcaaatggacatatcatcagacagaatacgaatcctgttattgttgtaaaaggaaaggttaccgtagatgggcaggtatttgtaaagggagatgaagcagcaaccggacaggatgaaacaacaggaaaaagcctttccgggcagccagcgatccgtattgagaatggttccttagatattaaaaaagattccgtagtagcggcatttggtggaggatatatcgcaacaacatccgttggcggcagcggaattattttagataatggaagtatttccggtgagggaacattaattgcatttggtggtaacggtacatatgatgatggcgcagatgctatcagcggtaatggtactatttctgtaaaaaatgtttatgcacaaggtggatgcagcagtataccaaaaacaggtgctactgcgggaaaagcaattgcagatggggtaacgcttgctaagacatccaatcggacattgctaaacggtaaggaaatcaaggataactatggaacaatttctgagttgtactggtcaagtattacaaaagttccagatgtgagcaagtatgtgatagaagtaaatggttctgatgaagaagataatacgaaaccaggcagctctgaagataagccaaacaataagccgggtgattcagggaataattcaaatacgaagccgggaacatccgaggataaaactaacacgaagccggcagcttcagaaaagaagtcagagacgaagccagcttcaggttctacagttaagaaaacaataaaaacaaagtctttaaaagtgaagaagacaaaagttactttaaagaaggggaagaaatataaaatagaagccaagaagattccagcatcttctactgctaagattatgtatcgctcttctaataagaagattgccaaagtaacaaaaaaaggtgttattaaggcgttgaaaaaaggtaaatgtaaaattactgtaaagaccagtgatggaaaaaagaaagtaattatagtaaaagtaaaatagtaaaagtgaaataattgaaagaattcgggagataccatatttcccgaattttttctgtataaaaaccttcacaatagaaaaaaatgtggtagaatttatttgtttacagacttttttataaggggggttttgcgcccatttataagtatatcagatggggagtcaatcccccatctgatatagcctccggcaggattgcagagatgcgcagaagaagtatgtcatgcattgcatgacgcgcatctcgcagcaagaatgctggggcattcttgattagatgtgacataatatagatatgtacagtaaactagttttacgggcttactgtagaagtaaggaaaagaggacaaacataatggaagaatacttgcgtacctattgtgaaattgatttaaaagcaatcagggagaattatataaatatcaaaaagaagactggagataatgcaatgacaatggctgttataaaagcagatggttatggtcatggcgctgtagaagtggcacattatcttagtgatatcgcggattattttggtattgctacgattgatgagggagtagaactgagaaaggctggattaaagcagccgattttacttcttggttataattctccttctctttattataagaatttagagtatggtgtggaccagacgatttattgttatgatacggcgaaagcgatgtccgaagcggctgtgaaggctggaaagacggctagaattcacattgcattagatacaggaatgacaagaatcggtttatctccagatgagaaagggcttgctattgtggagcagattgcgaatctgcctaatataaaaatcgaaggattatttacgcatttatcctgtgcggatatgacagataaggcgtatacagaaagtcagatgaagagatatgattattttgtagaactgcttgataaagcaggaatcaagattccggtaaaacatatctgtaatagtgccgctatcatggaatatgatgaccatcgttatgatatggcaagagcaggaattattctttacggaatgtacccttctgatgaggtggatttttctaatttagagttaacaccggcaatgagctggtattcacatgtagtgaatattatggagccggagatggaacgtggcgtaagttatggagcaacctatgtggttgatcatccatgccgcctggctacggtatcggttggatatgcagatggatatgcaagaagtctttcgaataaaggctgggtattaattcatggaaagaaggctccgatcgtaggaagagtatgtatggatcagatgatggtagatattacagatattccggatgtaaagcttgaagatatcgtaaccctgattggaaaagacggtgataattctattagtgtagaggatatggcaaatcttgcaggaagctttaattatgaatttgtatgtgatgtaggaaagagggttcctagagtatacaaaaaataagtttgatgtgcttatgtgatatataattatgtgataagaaagagagaagtgtatgaagtttaaacagggaatattctttcatttgtaggatcttctgctggagcgacatttttccctgatgaagttattgtagatgatacaaggagttatccgattgatatggaagtactcgaggcacctgagtttgagggtggagaggattatgcagtacagcagggagctggtatggcagtaacaaagacagatgaaaagcagatgtatgcatctgttcagttcttaaaatggtttacagaagatgagagaaatattcagttttctgtggcatccggttatctgccggtaacgaaaacagcaaatgatgtcaaaaagattgaggagacaacaaatctgacaggaaataatgaattaccaattgttaaggcggcaattgatacagtaaatcataatacattgtatactacaaaggcttttgaggatggaacagatgcaagaaatattctggaatatgctatgtctgataaagcaagtgcggacagaaagacggtagtcaaacgtctggaaaaaggtgagtctttcgatgaggcagtaaaggattttgtaagtgacagcaattttgatacatggtatgaggcaacgaaggctgaacttgaaaaggttgtaaaataaaatgtaatttggaaaaggggaaaatggtggagaataatatcccgtccgggcggtgacgagttttatattttattttatgggtattcgagcaggagtgagatacagagatatttagatcagctcgaaaaagatattagagctcagtcaatacttttgccaaacggagatccatttatgctgcatttgtcagcaggagtggcatggtatccagatgatacaacagatagaaaagaatttacgcagtatgcagattttgcaatgtatcagattaaacgtacagtgaaagatcagtttggtgactttgataaagaagcatatcggacaagtcaggaacaatataataaagaaaaagactgagtgagttttatgctgaatatattgtgggtatttatgatcgcaggaggaattttatttgcgtcatttcatggtacgatgggaaaactaacagaagtttttatttcatcttcaacagaagcagtgaatttatgtatttttatgctgggagtgatcggtgtctggaacggaatgatggaaattgcagtaaaaagcgggcttatgaagagagtttcaaaggcaatgtatccgtttattcactggctttttccagatattcctcctcagcataaagcaaatgaatatattgcagcaaacatggcggcgaatatccttggtcttggctgggctgcaactccagccggacttaaggcgatgaaggaattaaagaagctggaagaaagtaataaaggcaatataagtaagaaaagctatacagccggtaacatagcaagaatgtcagaggatacatatgaagcatcggatatgatgtgtgcatttcttgtgttaaatatttcatcgctgcagcttattcccatcaatatgattgcctatcgcagccagtatggttcagtaaatccgacagcggtggttctgccggcaattttagcaactatgatttcaactttagcaggaattctttttattaagggaatggaatttataagatacaatggacgaaacaagaagaaacggagacgattacagtgaagtttcttctttatttttcggattttattgtgccgtttacaatgttttatattattgtatacggtttttttaatcataccgatgtctatgaaagttttttaaaaggagtaaaggaagggtttcatatagtcatcgaaatcgcgccaacgatgatagcacttctcgtttcgataggaatatttcgagcttcaggagctttagacagcttttctgatttccttactccattaggaaaagtccttcatattccggcagaaatcatccctgtttttatcgtaagaattttttcttcatcggcagcggtaagctttgtacttgatatttttaaagaatatggatcggattctaaaacaggaatgatcgtttctattatgatgagttgtacggaaacagttatttatacgattacgatatactatatgagtatcaacataaaaaaaacaagatggactttaccgggagcaatgtttgcaacaatagcaggagcaattgcaagtgtgataatcacagggtatgtaattccataataaaaacagacaaaacgcaaaaagtataattattgcgaccatctttacagttacaataattatactttttgcgtttcgtttgtttctaatgaattaaactgaaattacagaagataatcaggtaagtcaactccaaatccatgatgaacaaaaccgatatgttccagtgtaatgtgttcaatagaaatcttatttaacgtcatatgctgcatactgcttccctcccaacttaaattctgttattttattataacaaaagaaaatctatttgaatagaggataatagatgaacttcggctaatttttgggcacaaatagaaatttttttgacattagctttcaaaaaagaaatacaatgaaaaaggataaaagacatgaaataaagacatttttaataatgagcttttttgaaatgtgaaattgtccaagaaaaaaggtatgaaatgaaaaaaaattatgaatattgtgaattgaaaaaacagaaaaatattatataataagaaacgttgaaaaacgagttgagtccttgcgacgagaccttaaatataaatcttaattttcccctttaactgctttgcagattctatatggtgcgtatcgagtcataatgatgacgtcgatgcgttttttttattttaaaaagaaatctgttataataaattatatttacgaagggagtaatatagatggagtatttagatattagagataagaatggtaatcctacgggagtgattaaagaacgttctctcgttcatgcagatggagacctgcatgggacttcacatgtatggatcgtgaaaaaaaatgagaagggcagttatgatttattattacagaagagaagtgagaataaagatgcctttccaggatgttatgacatttcttccgcaggacatttgccggcaggacaggattatcttacctcagcattaagagagcttgaagaagaacttggaataaaagcagagccggaacagcttcattttatgggcttacatgaaggaaagtgtgaggaaattttttatggcaaaccgtttaaaaaccatgagatcagccatgtctatttatattctgaaccaataaatatagaagaattaaaattacaggaagaagaagtacaggaagtgtgctggatggattttgaaacctgctgtgaaaaagtaaaatcaggggataagaaatattgcctctttccagaagaacttaaaatgataaaagaatatttaaaaatttgatttctgagggggaacagacgaacagcaaaaatttatataaatttttgctgttctgtttgttggctccagatggaatcttcagaagagaaaaatttcttgttgtaggatttcatgtagaagtgaagttatcatgcgtctaatataactaaattttaagtatatacaacaattagaatgtcagtcctttagaatttaattccatggaaatccatatccttctggaaaattcccattcctccaaccttagattagccagaaaaaagaaaaaatgatatatcccagatgcgtcttcggagcgtgtttaagatgcggacgagcattttaaacacagcgactacagagcagatgggatatatcattttttcttttttcgtctataccaaatcaatactttactttttgccagatctcttctcttgagagtgagaagttctcagcaatgattctggcgatttccatgaagtgatcattcatctgatcaatgtttggatacttatggaaaagatacattaacttcttgatccactcgatgcctttataatcaaatgggtctttggataagatatcgcttacctgataaggaagaatctgcatccagatactcatacgggccagaaggtgcattgtaaaataaatctggcgagtggatccatattcagccgtattggtgtaatgttcgccgtaatactgaatattattgatggtttctttatgtaaaatatctatcttactattattaatatcatacttgacgcggataccataacggtgtttcagccatgcggcatatcctcttcgttcggcatggtattcagaccagtgctggaataatacagtttcgggatcatcaaataactgtcggtaagaagttagatgattcaggcgggcatagtctctgtaatcacagatatgggttaattcgtggaagacaaggcggtagacctcacaaagtggagaacgtcttaaataaggctctttaaatataagagtaaatggttcatccatatgctttggatacttcatacaggcagcaacatgcttccagtttttgcgggcggctgcctcatcaagacttcgagagtcttctttattaaaaccatattttttctgacaggtatacatatcatctgtcaatacaatctggacatttaaattctttattttaaaaaactgaatataagagttcataattctgttgattgtcttcatcataatgctgcccccataagcccaaatagagcctgcttccctttttattactgattagtataacacaaaatatatatagggtcaaaatgtatacaaattttagaggaaagagcttgattttctcctttttttcccttgtttcataaagtgaaatgaactatactagaaaattgcaggatataatagaggttttgtatatattaagaaattttaaagaggaggaaggaaaatggacaagaagaaaaaagctggtctggcggtgttgatcatcattgctttgtatgttgctgcatcaatcttttttcagtatcattattttataggaacaaaggtgaatggatattcctgtgcattccgtagtgtttctaaagcaaaggaactgattaagaaagatgttaagtcatataagattacgattaaggaaagagataaaaagaaggaaagtgtttcatcctctcaggtgaagcttgcatttaaagatgacggaaagctggaaaatattaaggcaggacagaagggatatgcgtggatcacagcattattccagtttcagaattataaagatgcgattactttaacggtagataatgatgcgtttaatgatacatataagaatttaaatgcatttaataaagatatggtaattgcgccagtagatgcatattctacatatgatgcggtatcgaacagctacagtattgtacctgaagtttacggaaatacagtaaaaagaaagcagtttaagccaatattaaaagaagcaatcttaaatatggagcgtagtatcgatatagagaaaaaagattgttataagaatcctgtgtataaaaaagatacagcagaagttgtagcggcgaataaaacattgaataaatatgttcgggaaacgattacatacgattttgatgaccgtaccgaagaagtgaacgcaaagaaacttagtaaatggttatatgaaacggataagcatgaagttaaggttcatagcgagatggttgcaaagtatattaaaaatcttgcaaagaagtatgatacagttggagtaaaaagacattttaaatcgatatgcggtaatgacgtagaagtcagcggcggtacctatggctggaagattgatcaggaagcagaaactgccaatctgatcaaagttattaaacagggaaagtctgttaagagaaagccggaatatgctcatcgcgcaaaaagtcgtaagaagtttgatattgggaatacttatgtagaagtaagtttaggtgaacagcatatgtggttttataagaacgggaaaacgttagtttctacagatgttgtaaccggagatatcagtaaaggacatggaacaccaaccggtgtttactacatcctttataaaacaacagattatacgttaaccggtcagggatatgcctctcacgtagactactggcttccattcattcagattggtgtaggaattcatgattcttcatggcgtggaagttacggtggaggaattttcacttatgatggttcccatggctgtgtaaatacaccaagaagtgccgttcagaaaatctataataacatcgaatctacttatccggtagttgtgcattggtaaataatttctgattgtgtaaatttataaaaattaaaaagtattctatagtagcagctaaattcacatgtctaaactttttatgttactatagaatacttttttattttttgtagagcagctagaattataaatcggttagaaggtttgtggccgttcgtatttctttacgtagacgattactatggcggattgcctgaataatatcctgtttggataaggtttcctgttcattaagggctgcataagagaatgccatttctaaaagtgtcagtgggagttcagggcgtttcgtggactgatcttccggttgattttctggagaggatatagcaatcagggtgcgtagtatcttttctgttgtgtcggaagaaaaggcattgtatactttcgtttcatattcaatggcaggaatacttccgtaaagaatggaaagtgtcagtttctcatcaggttcatctattgtgatcggataaaaacggcgggagagtgctttatccggaagaaggaactgacggtattcttcttttgttgtagctccgattattttaatatcaccgcggtcaatataaggttttaacatattggaaatatcgttgttggagctttcggtagaaccggcgccgacaatcgtatgaatctcatctataaataaaaggacatctggatgcgattcaagttctccggcaagttttttgatacggtcttccatttcacctacatattttgttccgcttaaaagagaggttgttgttaatttaaaaatctttttatttttaagaaggtccggcacgtttcctttttgaagacggtaggataaaccttccacaacggatgttttaccgacaccggcgtctccaatcagaagaggggacttctttggtgaaatcaaaattaattccagatcagcaatctcctgttcacgtccaattgccggattggtgtgatagattctagtggtcatattataggcgtaggtatttaaaaattcgctgtcaacataagcgctgtcgatatctattgaagaagatatagcggcagcggcagtgtctgtagaatcttttacaacatttttatgggcagtaaaccatatagttcttgcagcaagataggaagaaaaagaagaaagctcttctggagatactgcctctaaaaattgctgttctcgggcaaaaaatgcagcaagcagggaaagagtatctttgtgtgtttttggagagtttttttctaattttatttctaataaaaaagcaacagaatcgagccagtattctttttcatcaccaaagagagcaagggtatttattagtatttccgccagaagctcttctgtaataaaggaatactttttataattcggcgcatgttcaataattttttttataataagctgttttttctcagaggactttatcagcacagaataaaatgctttttgtactttttcaaaaagtttcgtattcatgaaacaggattcaagtgttaataaggtcatggaatatgcggaataataaggcgtttttaatgcttcaagaagagaggttgtataagtgagccagatatccttgttgaagtttttgtgtaattccagttgttcttttaattgtatacagtctgcaaaatattgatcaaaagcccccttttcttctggaaaggaaacattgaatctttcccggactaaattgcgaatatattcaaggtaaagttcatcattgtgaaaagcggaaatatgagcaggtgaaagaaacatacattgtatacaaatagtttcgggtgctaagggctgacctccttcttctataatagagtaagcttttgttaatgtattagttatagaatccacaataaatccctcctgattttcatgtacttttggaatctttttgtgattgaatttttcataaaaagaagtgtaataaaattccagagtacatattcatatctttttcataattataaggcatacatggaaaaaagtaaaaaaatattcttttctttgctttaaagctaaaaagtgttgaataaatgaaaaatttatggtaggataaggaagatttaataataagcaattatttttacaaaaatgaaagtgtataaaggagtacagacgattatggatatggatatgaaatttttcaggaaactgccggtaccaaaggatttaaaggagcagtttcctgccgatgaaagaattgtaaagattaagcaggagagagatcctgagattcgaagaatttttgaggggaagtctgataagttattattaattataggaccatgttctgctgatagagaggatgccgttcttgattatgtaacaagattgtcaaaagtgcaggagaaagtaaaagacaagattatgattatcccaagaatatatacgaataagcctcgtacaactggtgggggatataaggggcttgttcatcagccggatccggagaagaagccggatatgctgcagggaattattgctgttcgtgagttacatcagaaagcaattcttgaaagtggacttacttgtgcggatgaaatgctgtatcccgaaaaccatcgttatgtttctgatctgttatcttacgttgcaatcggagcacgttctgtagaggatcagcagcatcgtctgacagcaagcggtgtaggaattcctgtaggaatgaagaatccgacaggtggagatttatctgttatgatgaattctattacagcagcgcaggggcagcatgtattcttgtatcgtggatgggaagtacagtctcttggtaatccttatgcacatgctttattaagaggatatgtagataagcatggaaaaacatactcgaactatcattatgaagatttgaatgaactttttgaattatatcaggaacatgaattgaaaaatccaggtgtgatcattgatacaaaccatgcgaattccggtaagcattaccttgaacagattcgtattgcaaaggaagtactgcatagctgccgactttctaaagatatcaaaggacttgtaaaaggcctgatgatcgaaagttacattgaagatggtaatcagccgattggtggaggatgttatggtaagtcgattacagatccttgccttggctgggaaaagtcagaaagattaatttacgaaattgcagatttactataatgttgtaaatggatttcggtgctaattacataattatttataaatgctacaatttaatagacagtattttaaaaatatccggtttttttaaaccggatattgaattttatggggagattatgtaaaatgagaccaagggttgttctgtgatgttgattatgttacaataattttaaataagtcatttttgagtcataatcttgtaatataattttaacaactaagaatgaaaggaagatgtcgaatgcttacaggcagattactgattttaagcaagaaagaagcagaatgtaaagagatgacagcttatttcgaagatagcgggtataatgtaatctggtgcacagaatatgatgaagcaggagagattctttccaggggaaagaacaaaccggatctgctgatttttgatgtagatataccaaaacggcgagaatatgagactgttgagaagataagaatgtattctgacatggctattttaatgttgtcacaggatgataagctggacagtcagttatatgcctattctaagaagatagatgattatatggtaaagccggcaccgttaccgttgatagaggcgcatgtagaggcaatcatacgaaggacagtggagaagcggaatgcagtagaagctgtaggtgccttatctattgattatgaaggaagaaagatttatcttgcggacagaccgttaaaggtaacagcgaaggagtttgatttactggagtattttgtaaagcataaaggtatgattttatccagagataagattcttgattctgtatggggatttgattatattggcgggtaccgaagcgtagacacgctggtaaagaaactacgagcaaagttaactaaggaatatccttatattaagacagtttatggggttggatactgttttgatatttaaggatggtaaactcacaaattgtaaagagaggaaggcgagaataatgaaagtgaagcgaattgttagtatattcgcggtattattgttatgtgtatgtctgatcacaccgatcagcacagatgcggctgcaagagttcgtgtaagaacagtaaaaggagtaacaagctcttattccggtcggatgaattactgttatgtgaatggaaagaagattaagttaacgaagaatcctatttttaagaagtcaggctcctatatgggaccagttgcagcgatatttaaaaacagtggtttaaaagttaaggtaaccaccaaaggaaataaaatgacactgtcttacggcccgaatactgttgttctaaaggcagacagcagaaaggctgtgacgaatggtgtgaaaagtcagatgggagcaccggttgttcatggaacgtatacttctaccggcagaagaagatggattgttccattaaagagtgtatgtacacgattaggaattaattataagttatctggtggaaagattcgtatttcaggtacaacaaagagtagtgcttctaatacaacagctccgacgacagaagatagaagaacagagacaacagatagtaaagaaaagattaagattgttatcgatgctggacatggtggttctgactcaggagcttccgggaatggaatggcagagaagaatctgacactggcaatcgttcttgcagcaaaaagatcttttgataatgacagcagattccaggtttcttatacgagaacagcagatacatacccaagcttatctcagagagcgaaccttgctaacaatagagatgcagatatgttcctctgtgttcatatcaattctgcaagtgcttctgcacatgggacagaaacattatggagtaagggaagaaattctgcaacagcgaagaatggcttaacatcgaaagaactggcaacagcaatgcagagtgcggcagttgcagcgacaggatttacgaacagaggtttagtagaccgtccaaatctttacgtattaaaacacaccaagatgccggcatgtctgattgaatatggatttatcagtaataaaacggaggcggcaagaatgaaggcaaatacaagtgtgtatggaaaagcattatataatgctgttgttaatttgatgaaaaaagaaggcagatattaatagaagattattcatagagcatattgatatttgcagagaaaaatcatataatgggtattggcaaatctcacagcaagataatattttgtgttgctgtgagatttttatgtgactaaaacacaagatattgtataaagtatcattgcatcatacaaaattatgtgttacaatggcaatgcgtaatttttaaaaatttataattggagtgttggtatgaagatcattaaaagaagtggaatggaagttgaatttgatcgaagtaagatcattgcagcggttaagcgtgcaaataacagcgtcgtagaagcagaaaaagtaagtgacgaacaggtagagaagattgcagagaatgtagaaactatctgtgacggaatgaatcgtgcccttaatgtagaggagattcaggatttagtcgagaatcagatcatgaaccagaaggcattccgtctggcaagtaattatattacttaccgttataaaagagcgttggttagaaagtctaactctacagataaacagatattaagtctgttagagtgcaataacgaagaagtgattcaggagaattccaataagaatccaacagtgaacagcgtacagagagattacatggcaggtgaggtaagtaaggatatcacaagacgtttccttcttccgccagaaatcgttgaggcacatgagagtggagtgattcatttccatgattctgattattttgcacagcacatgcataactgctgtctggtgaatctggaagatatgcttcaaaacggaacagtgatcagtgacgttatgatcgagaagccaaagagtttttctactgcatgtaatattgcaacacaggcagttgcccagattgcaagttctcagtatggcggacagagtattacgctttcccatctagttccttttgtacagatcagtcgtgaaaaatatcgtcgagatgttcgcgctgaatttgaagcagaaggtctggaaatgaatgagcagaagataaatgaaatcgcagaaatgcgtgtaagaaaagaagtaaaacagggtgttcaggttattcagtatcaggtaatcactttaatgacaacaaacggacaggctccatttgttacggtatttatgtatctggatgaggtagaagaaggtccggcaagagaggaccttgctatgatcatcgaagagatgctcaaccagcgtattcttggtgttaagaatgaaaaaggtgtatatatcacaccggcattccctaagttaatttacgttcttgaagaagataacattcatgaaggaagtaaatactggtatcttacaaagttggccgcccagtgtacagcaaaacgtatggttccggattatatttcagagaaaatcatgaagaagttaaaagatggaaactgttacccatgtatgggctgccgttctttcttaactgtatatcatgatgagaatgataaaccgaagttttacggaagatttaatcagggtgtagtaaccatcaacttagtagatgtagcttgttcttccggtaaggatatggagaagttctgggagatatttgatgagcgccttgaattatgtcatgaggcacttatgtatcgccataaccgtttaaaaggaacaccatctgacgtagctccgattctctggcagaatggtgcattagcacgacttaaaaaaggtgagacaattgacaaactcctgtataatggatattctaccatttctcttggctacgcaggactttgcgaatgtacaagatatatgaccggaaagagtcatacagatccggaagcaaagccatttgcacttgaagtaatgaaacatatgaacgaagcctgtgcgaagtggagagaagagagtcatattgatttcagtctttacggaacgccacttgaatccacaacgtataagttttccagatgccttcaggaacgttttggtattattccgggagtaactgataagaattatattacaaacagttatcatattcatgtaacagaggaaatcgatgcatttgataaattaagctttgaagcacagttccaggaactttctccaggaggagcgatcagttatgtagaagttccaaatatgcagaataacattgatgcggtattagcagttatgaaacatatttatgacaacattatgtatgcagagcttaatacaaagagtgattactgccagtgctgcggttatgagggagaaatacagatcataagcgatgaacatggcaagctgatctgggagtgtccaaactgcggtaaccaggatcaggcaaagatgaatgtagcaagaagaacctgtggatatatcggaacacagttctggaatcagggaagaacacaggaaattaaagaaagagtaatgcatttgtagacaaaaccgaaagagcgcccatatcaaagagggcgctttttccatttctttatttttgacagagagaagatgagaagagatattgattatctatccattttcgccctaaaatatataaaataacggattgtaaatagagtgtggatattgtaaaatataactattaactaaacacattttagaacagacactctgtttaattttttggaagaggtgatatattatgtattatggtgagatcaagaagtgtgatattgcgaatggacccggtgtcagagtgtccctttttgtaagcggatgtacgcatcattgtaaaggatgttttaacgaggaaacatggagttttgaatttggacagccttttacagcagaaacagaagagcagattttaaaattattagagccttcgtatatatcgggtcttacagtattaggcggtgaacctatggaatatatgaatcaggaagccctccttccatttcttgaaaaagtaaaagaacgttttccggaaaagacaatctggtgctttacaggatatgtttttgaaaaggatattttaaatagaatgattccaaagtggaagtatacaaaaaagatgttagaacagattgactacctcgtagacggaccatttgtagaagcaaagaaggatattacactcagatttcgtggttcttctaatcagcgaataatagatgtaaaaaagagtcttgaaacaggtaaagttgttctatgggaagaacagtagagcacattaagatagtagaaaaggatttaagaaggggctgtcgcatcaaaaacagccctaccctatggcagggattcatgcattgcatggaatcgctgccatatttttacgaacaagcgtgggacctatggtataatcgcagatgacgtgcgttttgctactcaactttcgaacgtttatggaaacgccattcgcgctaaactcgcggccgctcagacaacgcgctcggtggcgggttcgttctcaagtttcgtgacgcaaaacctgcaaagcatctgctctttataccataggcatccacgcttttttcataaattttcggaatccgattccattgcaaatacatgaatcctcgccattcgccacgcccgatgccaaaagctgtttttgttttccctgtctgtggcaaagcaaaagaaaaaagaagggaagatctggaacggatcaccagcgggtatgggacacaactgagaatgaaccggagtatccagacagaaggctcagataagtgcgctttttcagcagtacaagtgctgtatcaaatttacaaattaaatttatccttttacagcaagaagacttcgacctctaaggtgggagatgaattgcgtctgttacttacttgatagagcgttctaatcatagtataatatctttagtcaaataataaaaattaaaatacaataaatttagataataacgcacctttagtattcttactatactagcatcgtgtgcttgtggtcaagtatcgcaggcgtttttttgcggaaaaggaagtgacagagtggcaaacagagcatataaattcagaatatatcccaatgatgaacagaagattttgtttgctaagacttttggctgtgtgagaatggtatacaatcattggcttgatagaaaaatcaggcagtacgaggagaacaagataaacgtaacatataccatttgtgcaaaagaaatggctgcaatgaagaaaacagaagaatacagatttttaaaggaagtagatagtatcgcattacaacaatcgctcagacaccttgatacggcatttcagaactttttcaaacagccgaaaactggtttcccaaggttcaaatcgaaaaagcggaataaaaacagctattccacggtctgcatcaatgggaacataactatatttaatggatatttgaaattacctaagattggacaagtccgcttaaaacagcacaggattattccagaggaatacagactcaaatctgtaacagtaagtcagacatcaagtggaaaatactatgcaagtattgtttttgagtatgaagaccaggtacaggaaaaggaattgcaaaagtttttaggtctggatttttctatgcatgaattatatcgtgacagcaatggtaaggagccggcctatccaaggtattacaggaacgcagagaaaaaattagcgagagaacaacgtaagctttccaaaatgcagaaaggttcaaacaatcgcaataagcagaggcttaaggtggcaaaacttcacgaaaaggtttccaatcaacgaaaagactttctgcataagcagtcaagacagataaccaatgcttatgattgcgtatgcatagaagatttggatatgaaagcgatgtcgcagtcactaaattttgggaaatctgttttggataacggctggggaatgttcacaacatttttgaaatacaaactggaggagcagggtaagaaacttgtgaaggtggatagattttttgcaagcagccagacctgttctgtttgtggttacaagaatgttaaaacgaaaaatcttgcgttaagagagtgggattgtccgcagtgtggaacacatcacgacagagatgtaaatgcggcgataaatatcagaaatgaaggaatgtgtctggtaaatgtatgaccttagagaacaaatacaaccgtgggacacacggggatagctcgcatatgcttagcacagtagtgctatcgaacgagaaccaaacttgccgaggttgggaagccccaacctctacaggtgggggaggatgtcacccatgtttatgtctgggaacttttttttgtacagggtcctttgttgtgagaaactgtacagctattcctaaaatgcagagcgcaagtgttaacgttgcgcttgagttcatagaagaaagatttgttattcccatatattctgcaacaccaggaagaagtccggcagcggaagaaccgcatacgattgcggaagtaaggataataaccggacgcatatattttacagcaagtacgccaacaataagcccggcaattatgttaataaagaactggatatctccttcaaatgaaaataatgtacctgcagcactaaatgcaaaggtaaaacacaggatgaaaattcctatccggtaaatccacagggcaagagctgcaatgaccgcaccgccaagaataatgcagagaacggatgcaaaaccttcaatatgaagaagctgggaggaaactgtctgaccaataaagagtccgatgatgaaaccggtaatactcataaaaactttggacagtttataaccaaagaaacatccaagaagagcaaagacaagagcaattacagagccaacaatcttataggtggtatcggcttcggttatgagtccgagaaaaccattattaataaaactgttcaggctgtcgctgcttccggaattcaatggaagagtgcccatcagagagctatagtcaatatttaacagggacaacataaaaacaccttctttcgtgttgaattaaaaaagttagattcttttttcactttttatcaactatgttattttaaattctgtttgtactgatttttagcttaacataataaagtatattctgcaatttatttcagatagagtattttatagatttttacgtgaaaagatgatatgataatacgagttgatttgtaactgtttaaagttgcattttaaagttacattgtatagattgggaaagagaggaattagagatgtcaaagattagaacaagatttgcaccaagtcctacaggaagaatgcatgtcggaaatcttcgtactgctttatatacgtatttgatcgcaaagcatgagggtggagatttcgttttaagaatagaagatacagaccagggacgttattgtgaggaagcactgggtattatttaccgtactttagaggcaacaggtttaaagcatgacgaaggtccggataaagatggcggatttggcccttatgttcagagtgaacgtgtggcatccggtctttatatggattatgcaaagaaacttatcgaaaaaggcgaggcatattactgtttctgtgatcaggaaagattagattctttaaaacagaacgtaggtggaaaggaaatcagcgtatacgataaacactgcctgcatctttctaaagaagaagtggaagctaatctggcagaaggtaagccatttgtcattcgtgcgaatatgccgaatgagggtgagactacattccatgatgagatttacggagatatcacacagccgaatgaggaacttgacgatatgatccttatcaaatctgatggatatccaacatataactttgccaatgtagtagatgatcatctgatgcagatcacacatgttgtaagagggaatgaatacctttcttctgcaccaaaatacacacatctttacaaggcatttggatgggaagaaccaaagtatatccattgtccgttaattacaaatgaagaacatcagaagctttctaagcgttcaggacattcttcttatgaggatttaatcgagcagggatttgttccggaagcagtcgtaaactttgtagcccttcttggatggagttcaccggacaacagagaaatcttctctttagaagagttagtagaagcatttgactataaacacatcagtaagtccccggccgtatttgatatggttaagcttaaatggatgaacggagaatatttaaaagcaatggattttgatactttctacgaaatggcagaaccttacatcaaggaagtcatcaagaaagatatggatttaaagaagattgcagcacttgttaaaacaagaattgaagtattccctgaaatcagagagatgatcgacttctttgaagaagttccggaatacgatgtagatatgtacacgaacaagaaaaataaaacaaatgcagaaaagtctttaccagtattacaggaattacttccagtaatcgaagcacaggaagactttacaaatgatgcattatatcagatgcttcgtggatttgcagatgaaaatggttacaagccaggctttgttatgtggccagttcgtaccgctgtttccggaaagcgtatgactccaggtggagcaaccgaaattatggaaatcatcggaaaagaagaaacagtaagcagagtgaaagcagcaattgagaaatt

SEQ ID NO: 432 - DNA, 30776 bp, Eubacterium hallii
tgcgacggacagcatcttcaagacgaaggataaaagctattggtgggcgagaaaaccgttggatgcgggatattaaccatcaggtgtcaaaggcactcgttaaaaataacccaaagcacactctctttgtattggaagatctgtcaggtattcgtaatgctgcagaacgtgttaaaacaaaagaccgttatgtttctgtatcatggtctttctatgaccttgaacaaaaactaatctacaaagcaaaacagaatcagtcttctgttataaaggtagaccctctctatacaagtcagtgctgcccttgttgtgggcacgttgaaaagtctaaccgcaataagaagatacacctgtttacttgtaaaaactgtggttacaaatctaatgatgaccgcattggagctatgaatctgtatcgtatgggaatagactatcttgcagatagccaagtacctgatacagttgtaacagagtaaactctgctacaaagggtgctgtcaaccaccctatgatgtaacgccactttagatagcaatatctatcggggattaaaggtcggaggtgtaagccgttagtacgactgggcagttacaagcccatgacctttaggtcgtgggtagttgacaaaaacagtagatagttaataatggcaatcaaaataaatagtaaggtggcgtacatatgaaacaagatactttagagggaaaagcgaaaacaaaaaatggtgtaaaacgattatgcttttccattgtctgtattcttcttgaagtgatttttatcattgttatggtgacacgcttgaatgaatatgcagaagttgtaaatttattcactaggattttcagtggtattttagttttgggattatatgcatccgataagacctcttccatgaaaatgccctgggttattttaattttaatttttcctgttatgggggttggattgtatttactaattggtttaaacggtggtacccataaaatgagggagagatatgctgagattgataaaatattattacctatgcttccggataatcaggagagtttaaacaggataaaagaaaagattccaaaggctggaaatatagcaaattatatatacaggaattcgcagtatcctatttatcagaatacagatattgtctattatgatgaggctgtgaaaggattagaagcacagcttgaagatctctcaaaagcacagaaatttatttttatggaataccacgcaatagaagatgccgaagcgtggcataaaatacaaagtgttttggaggaacgagtaaaagcaggtgttgaagttcgagttttctatgatgatatgggctcgattggttttattactacagattttgttaaaaaaatggaacggatagggattcattgccgggtttttaatccatttatgcccggattaaatttatttttaaataatcgtgatcatagaaaaataacagttattgatggaaaaattggatttacaggtggttataatcttgcaaatgaatattttaattatacacatccgtatgggcagtggaaagataccggaatccgtttagagggtgatgctgtttgttcacttactgtaacatttttggaaatgtggaatgcgatcagcgataaagatacgaatgattttgattttaaaaaatatatttgtcatcctgaatataaagcatgtcaaaccggatttgttcagccttatgcggacagtccgatggataatgaacaggtaggggaagaagtttatatcagcatgatcaataaagcagaaaaatactgctggtttatgacaccatatttgattataacagacgaaatgacacatgccttatgtctggcagctaaaagaggcgttgatgtaagaattattacaccgggtattccagataaaaagtttatttatagtattacacgttctttttatcatgggttagtgaaacatggtgtacgtatttatgaatggacacctggcttttgtcatgcaaaaatgagtgtggcagatgactgtatggcaacttgtggaacgattaatctggattatcgaagcttatatcatcattttgaaaatggatgttttatggcagattgtcagactgtgatagaaataagggacgacctgacaagaataataaaagagtgtcgtgatgtgacagatcagtatcgtacaggacgcagtgcatatttacgactggggcaattatttatgagattattcgcaggattattataaaaatgcggatgggagagacaattgttaattaaataagtgatatcaaagagacgtttttaagttactcttgcaatgtaatcctgagggagacattcttgattgtatgataactgaaaatgtctcttatttttatgattttctattgacaaccgaaaagatgttcgctataatacaaacatacatacggaatatatgttcggaatatttgtttggaacatatgtatcacacgaattatttataatatgcactttcggaatctctttgtgcttgattttgcaagaaagactccgagggtacatcaattaagtatggaggggttttttatgcaagagatgagtattagaacaactgcacagatttataatttttcagaattacagaagaagaagcacgagagagaacttcgtaaaaagcgtccattttttattacagggattatagtattcattagtttattgacgatatgctgtttcttgtattttagcaacagcatagtcagagcgaaggagccttcttctgatatccagtataaagtggtggaagtacaagaaggagacagcctctggtctattgccaggaagaatatggaagagaaatccaatgattatggttttactgatatttatcaatatatacatgagattaagaagtgtaataatatgaagtcgaatcagataaatacaggatgctatctaatggtgccatattataattaattttttaatagagccattgaacaagaagcctccacttcaaaatctatgatttaagtgggggagcatgtcacatacaaaacaaaagcatagtatcctattttcaatactcagacgagtattattcatacgatactatgctttttaatttcatctttttaaactttttaaaaagcagcagattgtggttatttttctcttagttgtattttaccggctgccattcttcgtcgttgatcttccatagcggcataatgttttcttgttgtatttacatctttatgtccaagaacatcagcaaccagatagatgtcaccggtttcctgatagagctgcgtaccataagtactacgtaatttatgtggtgttatcgtttttaacggagtgacaggacgagcatatttttttacaaggttctctactgcccgaacactgatacgtctcttttgcattgacagaaagagcgcatcttctgaaccttcttttggaattatgttttcccgctcatccaggtaatcaagaagggctttccgaacttcctctccaaagtataagataacttctgcgccaccttttcgatgaatcttcattccgtttgtttcaaagtcaagattggatatatcaagaccaacacattcggatacacgaattcctgtaccaagaaggagagtgagaattgccagatcccgtacttttgttttattatgatatttcttttgagacgttgttaaattctctccatcctctacagcatctaacaatttggcaatttcatcgatttctaatcgtgtaatagcatgttcatgcttctttggaagatttagaagactggctgtattgttttttattgcctgctttctgtaaaagaatttataaaatgtccgcatgcttgctgtttttctcatgcgtcctctttcttcatttgtatggactttattatcggcatcctcataaagctttaaataatctaaatattcttcgagctgggttaaagttactttatcaagaactgttacaggccatgtttttaaacttccttcctcgatggatggatacttttcctgcagaaaatgaaagaatatttttaaatcatatgcataagcgatacgggttcgggaagaagtagtaggttcaattcctcgaaaaaattctttgcaaaaatcaggaagttccacacaaagttctcgaagctttatctcatttttcattgtaatctgctcattataggttggttgctgcaaagttattgctcctttctctcatgaatcttgtcaacatttacaatatcatcaagcactgcacgaatcatacgtgcttttgcaccaggatattgatgattaatttctcctataagattctttacatcctccctttttgttgaaccgtcaacagggcagggactttttactaccggaagttgatattcttttacaaatcctttcacatctccctcatacaagaaaagaagtggccggattactgtaataccggaacggtcgaggtatgtaactggtgcaaatgtatgaattcttccctcaaatagaaatgacatcatcatagattccaagagatcatccttatgatgcgcataggcaactttattacatcctagtttttttaccgcatcatttaatgcacctttacgcatttttgcacaaagagaacagggattgctttcctcacgaatgtgaaagacaacctctgcaatctgcgttttaataacatgatattccacatctcgttctttgcaaaatttccgtattccatctaaattcaggttatcaaatcctaagtcaacagttacagccacaatatcaaacttatgcggataaaactttcgtaaacaggagagcgcataaaggagtgttaaactatctttgcctcctgaaattcctactgcgattttatcattttcctgaatcattccatattcgtcaattgcctggcgagttaagcttaataatttctgtaatttcatataataattcctaacatatttttatttatcttttatttatcttagcacaaatgttctgtttcttcaagaaatcggaaagtattacgatagatttttatgaatgtgtctccaaatagtaacataagatataccagatataaaattatgtgtttatggcgcgcatctcgcagcaagaatatcttgacattcttagattatgcaaatatctgtaactggacaggctggacgtttaaaaattgttttgatataatatgaaaatacgtcagcaggaaggaggctgtatgaaaaaattcatcgaaaatatcattattattatggtgcttaccgttgcgattttattttcctacgctgtaatggaaaagaaaataagcggaaaaagtagttcagaatttattaactttctttttaatacacaggaaaaagcttccgataataaaaataccgataaaacttccatagaagattctatagaacaagaaagaaaactatcagatactatggattataaggcagtctggcttagttatctggaatttaacagttatcgtaaatcagtaaaaaataataacgaaaaaaactttcgtaaattttataaatatatcttacagcacataaaacttcttggatttaaccgcattatcgtacaagtacgtccttttggggatgcactttatgaatcacagtattttccatgggcagcttgcatttctggaaagcaagggaaaaatccaggatatgatcctttaaaaattatgacggaaatgagccaccaggagaatattgcgattgaagcctggatcaatccttatcgcatctcttctggcgattccatacaaagtctttctaaaaccaatcctgctaaaatatggttttcttctcagaatacaaaaagaaatgtactttcttataatggcagtctttcttataatccttcttcagaaagcgtaagaaatcttattataaaaggagtagaagaaattgttcaaaattatgatgtagatggtattcatatggatgattatttttatcctgcatttaccgaaaaaaatgtaggaacagcctttgatgctccagagtatgaacaacagataaaatcggatatgtcatcaatagattctcaatctttttcctcaaataaatcctcaaatgaaatctctttagcagattggagacgtaacaacgtaaatagactggtatctggaatttataaagctataaaagaaaacaatccacaagtcacttttggaatcagccctgccggaaatttagataatctgcgaaatgatttagaatactatgttgatattgatacatgggtatcccaaaatggctatgtcgattatttgatgccgcagatttattgggggtttacgaacgagacagcgccttttgataaagtgactgatgaatgggctgccctcatgaaagattcctcacaaaaactatatattggacttcagctttaccggatgggtagtacggagccgggacagtcagataaaaaagagcttcaaaaagcctctttactaaaaaaagaactttcctatctaaaaaagcagaaaaaaatagaaggatactgcctgtttagctatcagtatcttgattgtcagaacaaaaaatatcattttgacgcagagcaattttccacaaaaagaaaaaaacttttaaatcagattgtaaaatccttaaagaacaattcatagcatctatttgaaaaaacgaaaaacgacatccacgacaaatttcattccactattggaaaatctatgatatattaaaagtaacaaaaagagctacttatgagacagcaggagaacttacataccgctgtaggaagtgtgcagcgaaaaggataatttccatagaaaaattagcttatccaaaggcaggtacatcatatactatttctggaaacgagtataaggtatcaaagccaggagcagaggtaattcttgttaaaacaagtaaaactaccaaaaatgtaaccgttcctgcacaaatttatgcacagggaataacctacaaggtaacatccattggagcgaaagcctttaacaataataaaaaacttacaaaagtaacgattggaacaaatattgtaaaaatcaatagcaacgcattctttaattgtaagaatctaaaaacagtcattataaaatctgtgcgcttaacaggaaaaactgcaaataaaaaagcttttaaaaatgctcacaaaaagcttgttattcgggtgcctaagaaggtaaaaaagatttataagaagatttttaaagggctgaaagtaaaatagtaagaagattgccaatgaaaaaaggtcagtaaatgctggccttttttcattgaaataaaatatttctaaattataaagttgaaaacctagaacgtaaataatagatatataaagtggttacagatgctcttttctttttaactattcgttaaagttggatttcgcgaatagttagattgctcttctgattaacttaatattggttaataagtttttagacactcaaacatctttttaatcttccttgcaccattatttatacttacttaatctccttataaaaccgtcgaattcaggaacagtaaaatctaattctttgtatcgaattggataaataattcctttattaattaactacgctctgattgtagaaatagagtttacatttttgtgtaaattttttgctacatttgatattgtgcaaggtaattcaccgcatttaaccattgcaaataaaaaaggcatcctattcctctaaagaatttaagaatgcttttttatagctgtttagcctaacaaattattacttaatttcaacaacttcgtaatctttatcttcaactgttttctttaagacatcatctgcaatctctttttctaaagtaactacagccgttcccttctcatggcttacttctgcggaagctacttctggaagtgcttctaatgctttctttactgttgcttcacagtgtccgcacatcattcctttgatattcattgtctttgtcatttcatttacctctttcttttcattattatttatgttaattaaactaacatctatcgcgtttttcttctttttatctttttttgtgcttcgaatatttaacaggtttaaacgtagtgcgtttgtaacaacacagaaactggataaactcattgctgccgctccaaacattggatttaatttccatcctaatacggagatcaacagaccggctgccagaggaattccaattgtgttgtagaaaaatgcccagaataagttttcatggatatttcttaatacgccccggcttaagcggattgcagccggaacatccgcaagtttactcttcatcaatacaacatcagcggcatccatcgctacatcggtacctgctccgattgcgattcctacatcagcgcgagtcaaagctggagcatcattaattccatcaccaaccatagcaactttaccttttttacctaatgcctgaataacactttcctttccgtctggaagaacgcctgcgattacattgtcaacacctgcctgttctccaattgcctttgcagtacgttcattatcccctgtcaacataacaacatgaatccccatcgcctttaactcattaattgcctgtggactgtcttctttaattacgtcagctacagcaatcattccaagaagacgattctcttttgcaaagaaaagaggagtttttccagcagacgctaattgttctgcgctatgttttagttccttggagatagatagactcttttctataaaaagtaaattaccaccaataagagtttcttcattcaatgttcctgtaagtccattccctggaacagctttgaaattatctacaacagaaaccgtaaagtttttctcttcaccatattctacgattgcctttgctaacggatgctcactcttcttttccagtgaaaatgctgtttctaaaagttcctgttcactgattccgtcaaccggaagaatatccgttactttcggctgaccatttgtgattgttccagtcttatctaaggcaacaatatcaaccttgccggcttcctctaaggatacagccgtcttaaataaaataccatgtttggcaccaacgccgtttccaaccatgatcgcaaccggtgttgcaagacctaatgcacaagggcagctgatcacaagaacagagatccctcttgcaagggcaaaaccaacactctctccggcaagaagccagccgataatcgtgataatcgcaattgtgataacagcaggtacaaaaataccagacaccttatcagcaatctttgcaataggagcctttgttgccgctgcatcacttaccatcttgataatctgagatagagtggtatcctctcctactcttgtagcctcacatttaataaagccggattgattaatcgttgcggcggaaacagtatctcctacagccttatctactggaatactctctccagtaagagctgcctcatcaatcgcactatttccctcaaggacaataccatctaccggtatactttccccaggcttcacaagaaaaatgtctccctttttcacctgatcagcagaaatcaacaattcctgttcattgcggacaacggtagccatctttggagcaagattcataagactctttaatgcatctgttgtttttccttttgaatatgcctctaatgttttaccaagagtaatcaaagtaagaatcattgccgcagattcaaaataaaactcatgcatatagctcataacaagcttatcatttccggcagtttgtgctacggtcatcgcaaacagagcatacgtactataaccaaatgctgctgttgcccccatcgcaactaaagtatccatattgggtgccctgtgaattagacttgtaaatccgctaataaagaaacgctgattaattaccataatgattacagtaaataaaagctgtgcaagtcccataccgacatgattattatttaagaagcccggtaacggccagttccacatcatgtgtcccatagaaaggtacataagcggtatcaaaaagataagagaaataatcagtctctttaataactttggtgtctccgtatctgctaaagcttccgctccctgactactctccatctgcgccccttttacagaagcatgatagcctgctttttctacggctgccacaatatctgctgaagtagccgttccttctactcccatagaatttgttaataaacttacagaaacatctgtaacaccaggtacgttagaaactactttttctacacgagcctgacatgctgcacaggtcattcctgttacacgatactgttccattctgtctcctctctgtctgaaaaatctacttcattaacttttgcaatgttacgactaactcctctataacctcgtcatttcccgcctgaatattttcttttacacaggtacgaatatgattcgcaatcaacactttattaaaactattcaatgccgcattgattgcagaaacttgtgtaagaatatcaatacaatatgcatcattctccaacatcgaccgaacaccacgaacctgtccttcgatacgacttaaacgattaagcaatgccttaaattctttttctgaacgaactttcttctttacactgcaattttgacacttcggttgaaaagaactgtttttaaaactatcattcgctccacagtgacaagataaagaaatatcttctttattattacaacactctcccatagcattctcccttctgtaaattttattctctatcagataaataggattatataccccataagggtattttgcaagcaatattttaaaaaaattattattacaaattagaataaaaaaggatctatcctttgtaatgataaatcctttaaattcaaaaattttcaatattaatagtttccattatatcatcaatagtaaatctgttcataaaaatatttataaatgcacgtagtattctcttaataaaatgatttaacaatttccataattaaccatactataatcccatgtaatagtatctaataaaaggaattcttttgttcctattggttttccatcccgatatgtagaaaatacatcacacgatatcacattgttcttttttgtaatagtttccatcggagtatgcccaactacctgcaggaattgatgtgacttatacattttcacatctgtatactgtggtctgagccagattggggagccgtcataccacatctccatttttccaaaattattaatgaagtctaaaacagtgtccacatcatcgtgctttgtctttggaacatataattcaacaaaattcttagctactcctgcatgtgaaaacagaacattatcaattctgtgcacatactttattggattattctctggtaatacttcctttaaatcaagcaacttttttcgtacggtataagcagccatagtactgtatcccgtttctaactcacgccaaacataacttaaatcatgatttccatagcaccaggcagtatccggatatttttttgcaaaacgaatagcctcctcgtaagtctcctcataaaacaggatattaaactgtttgtcccagtcatcaggaatatccatcaaacaaaccgctctttgtgcaatccctcgctccatcaattctgctgcctgtttaaacataaatggttttaaatgtatatctggtattacaagaactttcataaatagtttcctcctttctgataatgagcaattcatataaaattgttgcaacttacctacaacacctgatacaaaatcccatacaactccctcacataaaatgtaggaaacagccaccatgcagtatgtccaggtaccgccccaacggaaaaaccaagtgtctttgctatctttgaagcgcgatactgatgataatcacttgttgcaatcgctatattcttacttaatcctctctcttctattatttttttagaaaatctcagattttccctcgtagaagttgatttatcttcttttataattcttgaagaatgaattcctttctttatcaggtagcggtacatgcactccgcttcactgattttttctccctcgcccattccaccggatacaatacattgtgaatcaggattttcctctaaatagataagagccgcatctaacctttcccgcaaagaacgactggcatgttctccatatactttacagccaagtacaatgagcgttgcattctcctttggcttttttattgatgcctttacgataaaaacggtttcgataattgcagttatcactacaacactaataacagctattacaataccaatcacacactttccaagaaaatttttttgcaaataaaatattccttgctgaaaattcttataaaaaatgcctccaagcagcaaaataccgctaactactaatcctgtaagattcccaatatttaaaattcggtgagtgaataatggaatactgaaccatatgaaaaaaactgcaccaattagaatcgttaaaatatgtattattttcaatttctaaaaacctgcctttcttatcttgtaaattttcaattacatatctgttacatatctatatccgctacacaagatctgattacttttataagtatagcatattgagattttcttagctatgatttatgtttctcttctttttctgcttttttacacttctttaatcggatgtactctcgagtctttcttgcacttgattttgtgagtacattcggcaaacaagttcaatcatatcaggatacttttttcaactgtataaaaattcaatatagaaagttcaaatttatttattttatattgaacttttttctttcgtgtgctatactctgtctaaatcttacaagcatacaacgcaaattgaactttgcgcaatcataaaaacagaaaggagtagctagatgattcaaaaagaagtcttctcagagcgattaaaagctgccatgaagaaacaaaacgtaaagcagattgatcttgtacgagcggcgcagccacagggtatcaaacttggaaaaagtcatataagccagtatgtaagcggaaaaacagttccaaggacggatattttattgtttttggcgaaaacattacaagtagaagaagaatggctgattggtgtatcggatatggaatctgacacagccatttctgccaataaaaatagagatctattagataagaacgatactagtaatactatacaaacaacctctgcagaaattatcagcagggacattagtaataaaaaggaaagaacaatgcgtgaatttaagaaatcatccaaattagataatgttttatatgatgtaagaggaccagttgttgatgaagctgctcgtatggaagaggctgggacacatgttttaaaattaaatattggtaatccggcaccgttcggtttccgtactcctgatgaagtaatttatgatatgcgccagcagttaacagactgtgaaggatattcaaatgcaatgggattgttttcagcaagaaaagcgattatgcagtatgcacagttaaaacatattccaaatgtgaatatcaatgatatctacactggaaatggtgtcagtgaattgattaatctttgtatgtcagcactccttgatacaggagatgaaatcttaattccttctccggattatccactctggactgcctgtgctacgttagcaggtggaaaagctgttcattacatttgtgatgaggagtcagaatggtatccggatattaatgatatccgcaaaaaaattaacgaccacacaaaggcaatcgttattatcaatcccaataatcccacaggtgcactctatccaaaagaagtgttagaacagattgtgcaggtagcaagagaacatcagttaattatcttttctgatgagatttatgaccgtcttgttatggatggcgaaaaacatatttccattgcttctctcgcaccggatttattctgtgtaacatttagtggattatctaaatcccatatgattgcaggctttcgtgttggctggatgatcttaagtggaaataaagctatggccaaagactatatcgaaggtttaaacatgctctctaatatgcgtctttgttctaatgttccaggccagtccatcatacagacagcactcggcggacatcagagcgtagaagactatattatgcctggcggaagagtttatgaacaaagagaattcatttacaaggctcttacagatattccgggaatcagcgcagtaaaaccgaaagcagctttttacatcttcccaaagattgatacgaaaaagttcaatattgtgaacgatgagcaattcgtactagatctgttacgagaaaaaaaggtattacttattcatggtggtggattcaactggaaacagccagaccattttcgtgttgtatatctgccacgaatcgaagtattaaaaaaagcaacgacaggtatggctgaatttttaagcacgtatcatcagtagattagtaagattagcttttctcttttaagtctgacagtggctggataaggtttcaatataattcagccactgtcagaagaccattttttaaatgattttagtaattcagtatctcttttcctaattcttcgtcagcatagaggatatctatatatccaccaagtaatgcaccatgcagtgcttcttttttttcaagtccggaagcaacacctatcttacagggaattttctttaattcttctaaagtaagactgatacgtctccttgaaaaggaactacttactgcttctccggatgcattaaaaaaacaagtgcatacatctcctacagctccttttttttctaattcaacaaaatcttcttcttttaaagagccagaatgatatagaatagtattccggcttaaatttcctataccaaaaagggcaatctggcaatcacgtcctaaagtaagtgcagcggaaatatttctttcttgttttaacatatcagcaatttctgcggaatctactgcaacaggcgcaggaattacataagcttctccacatcctgcccgggcaatcgcctgtgacagatcatctgctccaacaggaacagacgtcagatttgtctttccattaagctgaactacttttacattcttcacaccaagatctgaaatataatttgcaaaactcttcattgtacgtccccaagcagttccgataatgcttccatcttttaaataggaagaaaagtcctttgctgctgccctgcatacatcttcctgtacagcaattgacgtgcttgacagtttaggaacaagaaatactttctttaacccatatcgtttctgtaaggaatcggatagttcttcgttcgataataccggatattctacagtgatcttaatatatcccatctcttctgctttttttaacattctactgacggtagataccgaaattccctcttcctgtgcaatgatcttctgatccatatgcgattcataatatttttttgctactcgaattattttgattattttatcattcttcatacatttcccccacatttatcattattataaaataccaataggatagtgtcaatcaatagaacttgaaaaaagtgaaaatatttgcaaaaattaaatgtatagaaatataaacatagaaataattgcattttcattgacttatatgaaaaatcctgttatacttcaacaagtaagtgtttataacattttaaaacatttagtatgttcctaaccagattttttacaggataccttctgtacagatcaggttattcaacattttcaggaaaagttatcctgaatttctttctcccgaaggttctttcacttctgtttatatttccctactctactacagttccaaaaagaaactttgggagaagtttaaaagataaccccttttcaacttagatgaaaaataaaatataacgattcatgataagaattgatttcagttatgaaatatgatagaatgaatcttacggattatggcattgtattaagcaatgccataatttatgtccaaagaaaaggaaagtgagataggtattatgaaagaaaaaaagaaaatgtcactggcaatgcagatatttattgcattggttctggcgattgctgccggacttcttatgcaaagacatgcgcagtttgccgaaacgtatatcaagccatttggaacaatcttcttaaatctgcttaaatttattgttgttcctatcgtgctgttttccatcatgtgtggaatcatctcgatgcgcgatattaaaaaagttggggcgatcggtttgaaaacagttgtttactatatgtgtactactgcttttgcgattacatttggtctgatcggtggtaacttatttaaaaaattatttcctgtaattgccaccacagagctgtcttatgaaatcggagagaaaatatctttaatggatacgatcgtaaatatttttccttccaattttatttctccaatggccgaggcaaatatgcttcaggttattgttatggcaatattgatcggttttgctattattcttgttggggacgaaaagaatgaccggatcattacggcttgtaatgatttaaatgatatatttatgaaatgtatggaaatgattttgaaattatctccagtcggtgtgttctgtctgctttgtccagtagttgctgcgaatggagcaacgattatcggttctcttgccatggtacttttagcagcttatgtatgttatgttattcatgccgttattgtttactctcttgctgtaaaagcactcggtggaatcagtcctgtgacattctttaaagaaatgcttccggctatcatgtttgcattctcaagtgcatcttctgtcggaacacttcctattaatatagaatgtacagaaaaactgggggtttctaaagagatttcgtcttttattctcccactgggtgcaacaattaacatggatggtactgcaatctatcagggggtatgtgcaatcttcattgcttcttgctatggaatccaccttacccttccacaaatgcttacgatcatctttactgctactttagcttctatcggtacagctggtgttcctggagcaggaatggttatgcttgcgatggtacttacttcagttggacttcctgttgacggaattgctttagttgccggagttgaccgtatctttgatatgggacgtacaacggttaatattaccggagatgcttcttgctgcgttgttgtatcaaaccttgagaaaaaacgagaagcacgaaaacttacaaaaaactaatttcaagaatatctcggtattcttgaaaaaatacaaaaaataataaatgcacatagcggatcttctattgttactgcaaaagaaaagaatctctttatctctttctttgcacaaaaactgattcgactatgtgcattttttgttatatcatatgcgatatagccgccaacattcttatattttcaatctacacattggtatcgaccgtttattttctaaaatttagttctttgtttctattattcctcgaaaatcttcccaaaatcaggcgaaaaaactgatgaaattataagtacaatctataaataaccagaaaccatactatttcgcattctgttttactatttataaatcgatttttaagaaaaaacggcacaccgcatgtaaattatttgtcttacagtatttatctaacatttttcaagggatatatgttattaattgtaatatattaattaatattaattgataaaaatgcatcttgaagttttttttgagatgttgtatgctttagaaaaggtttttgaggcattttaaagcttttagggggaatatacccttatcaaaacttaacagtattgataacgtctcaaaaacaacgaaaaatagagctgtgagctttatcaaaacttattatcaaaattggaggattatcaatggtttacggatactgccgggtatcaacgaagggacaggcgaaagacggaaacagtatagaggcacaagaggcggcagtaagagaagcgggtgcagaagaaatatatgcagatgcatttacagggacaaagaaacacagaccacaactggacaagttgctaaaagtgatacaagatggcgataaagttgtggtaactaagttagacagaattgcaagaagtgccacgcagggaatcgcattgatagatacgatgcttgataaaggagtcaccgtacatattttaaatatgggtattatggataatacacctaccggcaagctgattcgaacaattatgcttgcctttgctgagtttgaacgtgatatgattgtcgaacgaacccaggaaggaaaggcgattgccagacaaaaagaagattttaaagaaggaagacctcgaatcagcaagataaagatagatcatgccctttcccttttagaagaaggatatagttataaacaagttgagagcatgaccgggatcagtaccgccacacttgccagaagaaaaagagaacggattttagaagaagaattttaagaaaattggaggaatttattatggcaaattttgcaattgcagccgatgaaaatgttatcgcccgcggcaataagcttatagaggaattacaagaacctggagaaaaaaaaggagttacactgaatcgtctttttgatcttgtatccacccatttgcaggaagatcaattaaaaagaagcggcgtagatacagaggcactagatgcttccattacgaatattcgtaatctattcactgccgccctctccggaaaagaagaaatccggacagaatatgaacgccgtatggcagaacttcgggaaagaaacgaagaattagaaaaaaactataagattcaactggggaaactcattacagagaaggaagaagctctacgaaaatacaatgatctaaaagaattgcaggaaaccgcagaatctgcaagaaaagctgccgaagaacaaacggcctctgctgtgaatcttgcaaaagaaaaagataaaacaaatatcatgctgatggaaaagttacgtgcagcagaacaaaaagctgaaaattataattctttagaacaaaaagtgatttctttaaatcaggaagtttcaaatctacaatttaaaataaaagactacgaaaaaaatgaacttctacatattaaagagatagagcagttaaaaaaagaaaaagagaatgattcttctactatcgaaaagctaaatcgggaaaaactccatataaaggaaaatacacaaaaggagctttccgaaaaagaatcccttcttactactcaggaaaaggaattaaatactttacgtattcagcttgcagaacaggtaaaagatgccgagcttataaaagaacgagctgttattgaaaaagaaagggaaatgatttccaaaacagaagaacttcgaaatacacttgatataataaaagaagaaaagtataatttacaacttgaactgagtcgattaaaaaaataatttatttatttctataacaagagggatgcctgccgttatgattgataatcttatctgtagacatcccttaaaatctttcattatccctacatttattatttttcatatagccaatttcgtgttataatcgcttaagtaaaaagaatgtaaacataacaggaagtgattttatttatgaaaagaattgattttgacaacggaaaaattactaccaacatctttcaagcagccataccgatgttgattgcacaaattttaagtcttctttataatattgtagatcgaatctatattgcaagaatacctgatatcggaacaactgcgcttggagcggttggtctgtgttttccaattatcgtgattattacagcttttagcaacttgtttggtagcggcggtgctcctatcttttcaattgaaagaggacgtaacgatacaaaaagagcaggtatgatcatgaatacctccttttttatgctcacgatatgctcgggtttactgatgtgtgtcggttttttatttgccaggccgattcttacaatatttggcgcatctgacaatgcactcatctatgcttatccttatattatgatttatctgatcggaacttttccgtcaatgatcgcaactggaatgaatccttttattaacgcacaaggatatgcaacaacaggtatgatttctgttattatcggagccatagccaatattgtacttgatcctctttttatctttgtatttcatcttggtatacgtggggctgctatagcaaccgtattatcgcaatgcttatctgctggatttgtattctattttctttcaaaaaaagcagaatacaaaattcgattactacataaagaagaaattaagaattgcgggaaagatgcaaaaaatatcgtcagtcttggaacagcaggatttgttatgcagcttacaaacagccttgtgacgatttgctgcaataatgttcttgcagcaacaggaggagatgtttatgtatcagttatgacaatcatatctagtgtacgacaaatgatagaaaccccaatatggtctatttctgaaggatcttctccgatcatcagctataattatggagcaaaacgaccaaaaaaagtaatcaaggcatggatcactatgtctgttcttgctttaatttacagtcttattgcctggggaatcattcttcttgctccaaaattcttaatcggaatctttagctcggataaaagtcttatgattgatacaattcctgcaatgaagctttactttgcagcctttatttttatgatttttcaatataccggacagacaatgtttaaatctctcaataagaaaaaacaggcaatttttttctccttactgcgtaaagtcatcattgttgtaccactgacgtatttacttccgtatgcttgtcatatgggatgtaacggtgttttcatagcagaaccagtatccaatgtacttggcggaagcctgtgctttatcgtcatgctcgctactgtccttccagaattaaagagaatgaatcctgatttgtaaagcgaaacagacgaaaaacagcaattgtatatagggtagactgtgaagatagtcgcggcatagaaaatgcctgactggcatttttatttgctccgacatcacattctaccctatatacaattgctgtttttctgtttcttggctctagatgaaatcaggatttctacctgagaaaaataaggggattgtcccaaagtctgtgatttttattcaaatgaaaatctccagtttgaatgtcaatcctttaaaatttaattccaaggaaagccataatattctggaaaattctcttttctttagaaatctcaatacaattcagttaagtaatccctcttcagcggtgtcgtctacaccaaatccacaaatcaataattaatgtctttgagctttattactgtagacttcacaaaatcttgcggcaaaagacggttcttccccaccggcataaagatgagacacatcacctacttttaaaccgcgaaaataagcaatgcctttttttctttcttctgttacaagctctgtaacagatgttggagctaatgcgagactattccataaagtaaatggagaaacattccacaaatgcgaaaggagtacacctataagaccgaagtgacagaaaaaggtaatcgtttttgtattttctttttctacgcgataatgaccattttcacgaacatacccatgttctgcaagaaggttatcaaattcttgtatgatgttatcatatacctcgaccatatcagaacactgtgctacaatggaatctctccatgcggttctatccatatattcgttatgttctgtcagatgttctggcatcatatcccatacgattcttggaagatatcctttttcgtttttctttacatcaggataagcttccgccagttcgggggctttatttatatctaattgtgcaggaaattcctgtaaccaagataaagtttcagcttcgcagcccactgcctccaaacagggttttgctgtacgctgtgctcttcctaatggagacatgtaacattctcccatttgcagagtaaccgctctcttggctaaaagatcggcttctctgcagcctttttcagttaatgtatcatttaagtagtcaggatccccatgtcttataaataaaattctcattgtatgtattcctttcttatctaattaacatatgtaaaattatgtaaattctataatagtttctattaatttttgagaggcaactggctttgtcaaatgtccattcatacctgcgtcactacattgctgcatacattctttagatgcctgtgctgtcattgcgataatcggaatgttttttgcatccgtacgtttagaaagtcgaatagccagacttgcttcaagaccatccataactggcatcataatatccattaaaatcatatcataggtatttggggcagatgccagaaatttctctacggcttctttaccattccatgccttttcaattcgtgctccgtattcctgtaaataaaattctgctatttccatattgaggtcattatcttccaccaaaagaatatgcattccatctaaacagttattatttaaactgttaacttcggaagcagtgttgccttttttcattgatttttctgaaatggctgaaagtgattcttttgtatcaagtaaggaactttctggctgatttattttaaatggaaggcggaaaataaatgttgttccttttcctaaaatactttctacttctatcgttccattcattgcttcaatcagctgtctgacaatagacatacccagaccacttcctttataacgtgttcgtgcatccacctgctcctgagtaaaaatatcaaacagttcttcctttacaaacttttcactcattccaattccgctgtcttttattttaaactcaaaccaggctgtagttccgtcaaaagaaatttcttctgtatacgtatcaattgtaccaccaattttattatatttaatagcattactaaacaagttcaccataatctgacgtaggcgcgtaggacttccaatcaccatcatatggtgtaaattttttcgatgcgtatgatgtgataatttcatttcaagaagctgtgcattaactaaagaaaatacttcgtcaataacctgtaaaaggttaaaagaaacttcctctaacataagtcgtccagattctaatttgctcatatcaaggacatcatctgcaagagacatcaaatgtccagcagaaagttgaactttatcaagacattcttccacctttttttcattgtctttatttttacggattatatcgagcatacctataattccgttgatcggagtacgaatatcatgactcatacggttaacaaactctgtttttgcacgacttgcagaatctgctttttcaaatgcaagctgcaggcgctctttttcctgctgatctttttcatgaaacaccgctgtattcttaaataaaataattccatgcactaccgttgactctttttgaagttcactgtcataaacagtatctcttgacattaataccgttttttgaagccagattggtttaccattaatatctttttcacgatattctactattacctgtttttctcctgtatggaaacgttccaataactttgcagatgagtctacaatacgataattctctatggtatcttctgttatcagctccttgtgttttacacaatattcattataagaacatggcagacttactttcatattgaatttttgtagactatttgaatgataaaaaatattttccagacgatcatgcgtaaaatccgccgtacaaactacttctgccgtatcaagtaatgcttctacataatttccattttcaagaataatctgtttcatctgctcataatactgcgttaattgcagcttttcatccgctgctgcaatatttttgtcatgaaatacttcaaatcccaagataaaatggtgtacggccccatcacgactggcatcataaaaaataacagttaatcttccatgtaatggggaatctccctttctatattgatatgaaatttcatgaacaaaatttttatttgtaagatgttctttcagataatcaatctgaagctgcgtccatatagtctttcgtgtagagtcagtagccagtttatgaacaatttgttctaccgctccggaatagcttccattttctgcaagaaaaaattcactactggcacgtaaagtacgatacttgtccataaatgcatcacaataaaggcaatcagaaaaatgatatcccatatcctttacctttgctaataaagactggttaatccttttttcttccgctgcctcttccattttggcacgattcttatcaatatacatatttttatcggcataacggaataattccctcatcgtagcctgctcaaaatcctgtgacagggcataaccaacagcataactgatcggcatttccggatgttcctttgaatacgtttctgtttgcttccgaatatttaaaagacatttctctacatgagcacgagtaaccccgtttaaaacaacaataaattcatcaccaccatcgcggcctacaaaatactcatccgggacagcaatgcgaagctgtttagcaaaagaataaatatattcgtctcctttatcatgccccagagtattgttaatattgcgaagattattcagatcaaacacacaaactgccacagcatcttcggtagttaacgatttcggtttattaagaatctcctcacatttatttttattcgaaagaccagttgcctcatcaagatataccttactttgcaaaatgcggttttgtgctgcataacgtaatgccttcacaagctcaatggcaatgataataataaggcctccaatatcaacgaaaacaatctgctctaatctgttaagagcagttgccttcctttgagagtacgcttcagcaagtccggttgcctcatcacatatattaaaaaaagtctcgctcatctcaataatatttgtattctcatatcctttttcacgaatgagaagaatctctttacataattcttcaaaatatctgttaagctcattcattttaacttgaaaagcagcatcatccaatcggacaagtttcaattcatcactgccataacgtaatcctttaatataggaagaaacactttcaatcatctcatcatgaggctgtccggcattctcaagctttataatacgctgtgttttaccacgcaccaatcctgcataattaaaacccttgctgtcccctgaatctgtcctaccagtaacataatgcaaaaaaacaatataattaaaactgttgttaaaagaatcatacagctacgggtaatatatgataatttctttgaatttaaaacttttttcatgtttaagcactccacaatcttgcaatttattttatacaaaacagtcctatggctattatataggtagccataatatctgtcaattatagtgaagaaagctttttgaaagaactatttataatggatattctaaaatatggaagtgaaaaaatatatagacaagttcgtgacaacagtgtatgatttttatttatatgaaacagataactataatacataaccagaaaggaacgattacttatgaaattgttgattgatgatgcacatattgaccttattaaaaaaatctgcgattactatcctgtagatggagtaacaacaaatccatctattttagctaaaagcggaagacagccgtttgaagtattaaaagaaattcgtagttttattgggaaagatgcagaacttcacgtgcaggttgtagcgaaagatgcggaaggtatggttgaagatgcccaccgcatcgtaaaagaattaggagcaaatacttatgtaaaagttccgtctgttccagaaggcttcaaagcaatgaaaattctcgttaagggaaatatcaatatcacagctactgctatttacaccccaatgcaggcattcctcgctgctaaatgtggcgcatcttacgcagctccatatgtaaatcgtattgataatatgggattcaatgggattcaggttacgaaacaaatccatgatatttttaaaaataataatttaaaaacagaagttcttgctgcaagctttaaaaattcacagcaggttcttgaattatgtgaatatggaatcggagcttctactattgctccggacatcattgaaggacttgttaagaatcaggccatcacttccgcagttgatgatttcataaaagactttgaagcattaactggagaaggaaaaacaatgagtaattatgatctttattaaatagaatatacgatgattaaaatttgtatataaaacacgtatgtcttttgtaaaatgtttgaaaatagtgttattttctcgttttttactttacaacaacaaaataaaccgttacaatacgcttgaagactatatttaagaattgaaaatatttacaggttataattgtaaaaaggagaataaacagctatggaaagtttaagagcaaaaaaaggctttatctgcgatatggatggtgtaatttatcatggaaatcaacttcttccgggtgtaaaagagtttgttgaatggttacaaaaagaggaaaaacaatttctttttcttacaaatgcaagcagtcgctcgcccaaagaattacagaataaattatatcgtatgggattggaaattggagaggaacatttttacacaagtgcattagctacagcgaagtttttacaatctcaagctccgggctgcagcgcttatgtgattggagatcatggactttataatgctttatatgatgccggaattacaattaatgatgtggatccggattatgttgttgtaggggaaactgtaacttatggttatgaacatattattaccgccatgaatcttgtaaataaaggagctcgattaattgcaacaaatactgacattaccggtcctattgagggcggtatcgcgcctgcctgtcgtgcttttgttgcaccgattgaagcaactacaggaaaaaaggcttattatgtcggtaaaccgaatccattaatgatgcgtacgggtttacaaattttaggtgtgcactcttcggaggcagtaatgattggtgatagaatggatacagatattattgctggtattgaaactggtcttgatactgctttagtactttcaggagtatccacaagagcaactatcaaagaatttccatatcgcccaagacttattttaaatggggtaggagatattgcgatctaattatttttgaagattgcgataaggcatgtagcaatctggtatcaaacgcgttcctataaggaatcaaaagaaaaaaataagaactgcctgtcatagcggctatctttatagttactatgacaggcagttcttattttaattacgttttccagaattacgaaaccatctttcactctttccctggtctgtaatccgatttaaatcaactcttccggatattcccggacaaaatccattagacgtaaattgctgcaggtctgctcccttatgaacatcgtagtgaggcttatattttccattatttaatccataacgagcttcccaccacgcacaattctttggtcgtctgtaaattacttgtttatacatttcgtactctgagtacatcgtataaagcatcattttatgtcgttgtctctttaaaaaatcgagagatctttctatatctgcttctgcattgcctgattccacatcaagcacataccctacaaaatgtttttctattcgttctctacagacttcgactaaaaatctggtttggtcaacttcttttcctcgatttagaaatgcatacaaccaatatggaattcctcttttttcacattcttttatattagtgtataatgttttatcgatataggaaatcccctgtgtcgctttcataataagaaagggacagcttctcttaacagtatcccagtttcgtactgggtgataatgactgatatctggataatatttactcataacatgttccaaaacactttgccaaacctgttttatttattaatatgcaaatcagtgcattttgattttaaaatttaaaaacagaatccttttatctatgcgatcattcctctgatgcttcccctcatctttcgaacaaaggaaaggattaatccagctgccgcaaaagtaagtatcgtcttacttcctgtaaaagcatctaagatccatcgtccaccctcaccttctataccgttatatccaagggaaagaaagccatcaataaatggggcaaatatcgtaataattagaaataatccgaaggcaaaaatgcctcttccggtgtcaatatttctaagaacacccatatccattacttttttagaacctaaaatccataaggcttcgataattccaaaaagaatgaaaaaggcactgcctccaacaaatataataccattaatatctctggaggaaggaagttccataattgcgcctatgcttgtataattgaagacatttctaaaaatctgcagtacaattccaagcatcagaagtgcacagagccaatgaagtcctgtaaaaagcagatttccggctgtttttacactctttcctacaacagttccggctgtagaagctgcgcttgatacagcatctccaccagcacttaaagcggagcggcgctttctttttgtctgagtggttcttgtatttcttgaagaacctcctcttttatttttaattgtaacttttacattcttctgctgctgattctccttttgcgcatcttcttcattatacactttatattctgcatccatagattcattattacctgctacttctttcggaagtggagctccacagttattgcagaagtttccctctgtctgtgcgccacaattcttacaaatcattgttcttcacctcatttcaaatatcttgtatcatcatatactaattttgtaaaaaagaaaaggggcaaagtttcctgatttttaccgggttcatttcatacgatactgcgtttgattttctttatctacttgtcgttataatatctctctttgtgcaaatggttccaaattattattacattcttttatgcacgcttataaagaattggaatatcatatccaaatgttctttttccatttacttccatactttcagccacttccaaacctgtctctgaaaaacgttcccacaatttaaacttcataaccggtgtaaactggcttgtacttccaccttcccaaataccatcattttcaacatataatgctggtgtaaacttttctgacttctttaattcactatattctaccggcagcatggaatcatacgtaaatgtatttttatctgctcccgccggtatttcataagatgaaagtaaaattccttccttttcctctgtaaataaaaaaatatggggagatgcatgtttctttccatttgtttcataatagctttcttctacaagaaactttccctgaaaatccactggaagatttttaatcttgtcattacagactgtattcacgtgctcagcatatggatatacttttcccgctttttgcatttcttcaaactgctctttattattaaaatgtcctgttataagcttcataaacatctcaagatttgagctcttttctttattatttaacataattctgcctcctattttatctattatgtactctcggagtttttcttgcacttgcttttgtcacatcataattctgatgttaaataaatcaagtcaaattatactggcgaattatcactacagccttttggtgcatatttttcaaacagccagtcttctaatgtatttaagttttcatctgaatgttcaacctctcgcgcatatcgccaggagatttcttccacatctttcatgaaaagtttttttccattctctagccaacgaacgattaaaaattcctgaatccagcgaacggaaaataatgccagttccattttagaacaaaccatatcatcgtaaacagctccgcaaaaatatgtataaacaaaaaacatcagcaattgttcgcctatattttcccactcttctttatgagcactcaacaaaccatacatttcgtgaaattcattacaaatttgttgataattttctttcgttgtcttataaagccatttatcagtcccatcaagcacttgattccattccggacgcaggcgttccagatgccgaagaatctgtaattcttctttttgccgttcccattgatgaagagatgcggcattaaccccctttcctgcaaggcatttcaatacgaattcctgcaaatggccttctttctgataacgcttacattctcgcaaaagattatcaatatcaaattctcgctgttcctccatacagatttggtaactttctgccagctgttcacaaacttccatacggagcgtcaatgaaatagaacgattttgcaaaatagaaaacagaacatctcgagtatcttctaactgggaaaacatcataaaatcaaactcttcaaaatcgtcttcctcatctgtttcttcttctagaaatcgaacaggttctttacaggacaaaatgatttttgctgcttccggacaagaaagtgataaggataattctctaagcccttcatattcttccgtatgtcttggataggatttacaggtatcacagagtgcatcgggtcctaatgctttataaagatcacacaaattttcctcatttaaaaacgcacaccgacggtt

SEQ ID NO: 433 - DNA, 29864 bp, Eubacterium hallii
ctgccttttgtcttgataacaaagaatctgcatagtgcttgtgtgtgatttttatattcaagtcgagcagccgcgagacttggcgcgtaattctggtcagcgtaagctgacatattctttacagaattactgcgcatcctcgcggagcgtttatcttagtcggagattggacttccaatgagacaaatttgctgtcactcaccaccggaaagaggtgggagtcttctcgactgagataaatacaaccgtatagaagaaaaagtaccaatgaaatattcttctatgatataatcaagtatagtatggcttatattattagcttatattatagattatatttatagaagaggaggtgtcttatgatcaaacataaggcggtttaccgcggtggaagcggagagattatagagaaaaagtcaagatttattgcgaatgttaagagcgtagagactgtggaggaggcacaggcttatatagaggagatgagaaagaagtactgggatgctagacataattgttctgcattttcagtgggaacagagcgtgtgataacaagatgcagtgatgacggagaaccaggtggaacggcaggaaagccgattcttgaggtgatatccggcagtggaatacataatattgttgttgttgtaacaagatattttggtggaactttgctgggaacaggggggcttgtaagagcgtataccgatgcgacaagagcagggatagagaattcagacatcgtagagaagattccaggaagaagagtagatcttgctatggagtatacagaccttgggaagcttcaatatttgctggcgcaaaatgaagtgcttacggaggatacagagtatacagacaaggttattattcatgctcttttttcggaagaggataaagaaagattaaagaaaaagataacggaagcaactagtggtcgtgtgacagtgagggaaggggatgaagtctattttggtacggttgggggagaagtaattatattttaattgcagcctgacttgtgatctgaatatagaaaaccggaagatatggtatgtgtcttccggctcttcaaaatattcaagaatgccccagcattcttgctgcgagatgcgcgtcatgcaatgcatgacatacttcttctgcgcatctctgcaagtctacactccgtttcggtcggcgcaaaaccattgtccaccggacaatgtgcgccctgccggaggctatatcagatgggggagtgactcccccactgatactgatttgttgctcgccacctacagaggtgggagtcatctcacatctgatataattatgcttttccgtttctcttagcacgataacgtgcagtaggatcaagaatcttctttctgatacgaatattcttaggtgtgatttcaagtaattcgtctgtatcaataaaatctaaagcctgctctaagcttaaaattctaggagggcttaattttaatgcatcatcagaacctgaagcacgagtattcgtaagtttctttgttttacaaacgttcacttcgatatcgtctgtttttccattctgaccgataaccatgccggaatatactttttcaccggcacctacgaataatgtaccacgttcctgtgcactgaaaagaccataagtaacggtttcaccagattcataagcaattaaggaaccttgttttctatactggatatctcctttatatggaccgtatccttcaaataaagtattgatgataccggttcctttcgtgtcagtcataaagtcaccgcggtatccaatcaagcctctggcaggaatggagaactccaggcgggttgaaccgcttccggacatggacatattacgaagttcacctttacgctggcttaacttttcaatgactacaccggaaaattcttctggaacatcgataacagcggtttccataggttctaattttttaccattttcatcggtatgataaagaacttctgctttacttactgcaaattcataaccttcacgacgcatgttttcaataagaacagaaaggtgaagctcaccacgaccagatactttgaaagaatctgtgttgtccatttcttctacacgaaggctgacatctgtattcagttcgcgtaacagtctatcacgaatatgacgggaagttacaaatttaccttcctgtcctgcaagaggactgtcattaacaaggaactgcatagcaatcgtaggttcagagattttctggaatggtattgcttccggatggtccggagaacatatggtatcaccgatatggatgtctgcaataccagagatagcaacgatggaaccgacagtagcatcatttacttctactttattaagaccgtcgaattcatataatttgctgatttttacctttttatttacggatggatcatggtggtttacaagaagtgcatcctgatttacgcggatagaaccattctcaactttaccaataccaattcgtccaacatattcattatagtcgattgtgctgataagaatctgtgtatctgcatcagggtcacccgttggtgcaggaatgtgcttgatgatagtttcaaataatggtttcatatctgtaccattttcgcttaattcaagcatcgcaataccagattttgcagaagcataaacaaaaggactgtctaactgctcatcatcggcgtctagttctaaaagaagttctagtacttcatccatgacatcttccggacgcgcctccggacggtcaatcttattaatacacacgataaatggaagatttaattcaagagccttttttgttacaaacttagtctgtggcataggtccttcgaatgcatctacaacaagaattacaccatcaaccattttcagtacacgttctacttctccaccgaagtcagcgtgtccaggagtatcaatgatattgatttttactccttcatagtgaatggctgtatttttagataaaatagtgattccacgttctttttcaatatcgttagaatccataacacgttcgccaacttcctgattggcacgaaaagtaccactttgctttaatagttcatcaacgagagtggtttttccatggtcaacatgggcgataatagccacgttacggacatcttctcttgagattttcataaattgccttctttctaaaagtgtaaagtataaattgctcatcacttgaggaatgaaccaatttataaccgtattttaacgttcaaactaagttattctagcacaaacagagtaaagacacaataaaaaatacgaaataaataggaaaataaactagaaagaataattttactatataactatatcaatctattgcagaaagatttgtcgttatataaagtggagaaaaagactccgaaaaaattaccttgagagtattttgaggacgtataggacatcatgcataggatatcatatagaaagaaaaaggaatatttttataatttttgtatatatataaactaaacaacatatacagaatctgcgctacatacagggaggagtaaacatgacagaaaaaattttaaaaaataaccaggcagttgttgccggagaaattatctctgattttgaattcagccatgaagtttttggtgagggattctattttgttaagttgagagtaaacagactaagtcattcaagtgatacgattccattattggtatcagaaagattaattgatgtgacacattctcatatagggcagtatttggaggcgcatggacagttccgttcgtataataaacatgaaaataataaaaaccatcttgtattatcgttgtttgtaagagaacttgaatttatagacagtatggaaaatcgaaagcctaatatgattttccttgatgggtatatctgtaaagaaccggtgtatagaacaacacctcttggcagagaaattgccgatgtattattagcagtaaacagagcttatggtaagtcagattatataccatgtatatgctggggaaggaatgcaaggtatgccggtaatctttctgtaggaagcaggattcagttatggggccgcattcagagcagggagtatcaaaagagagttggagaaaataatgtagtcagtagagtggcttatgaaatttctgtaaataagatggaatatatagatgatggaataaaccttgaaaggaaggttgcagattcgggaaatataggttaaattataagggactgttcaatttgagcggtcctttgatttatcatataataatatgatgtcagggtcaaaaggtcaaaacgccgttcgtgcttgtacgataaggtgtttgactttggaatccgcggaacatgagaaagtagcgatttacgtagtaaatcagcggattttgaatgtttcagaattacgggagttgcattagctgcggagtaattcgtgacatcaagttaggggcaaaataccttttgaccctaacatcataatataaaaaataagtaagaataaaagacagaaaggaaaacaaaaatgaagataacaccagtaaaaggtacgaatgattatttgccagcacaggcagaattgagaaattatttacaaaagaagatttgtgaaacatacgaacaggccggattccagagaatttctactccaattattgaggatattgagaatcttgataagagtgagggaggagataacctgaatttaattttcaaaataatgaagagaggagaaaagttaaagaaggcaatcgcaagtcagaatccagacaatattgcggatatgggacttcgttatgaccttacattacctctgagccgttattatgctaataatcgtgcatcattgccacatccatttaaagtaatccagatggaccgggtgtatcgtgcagagcgtccacagaaaggccgtttaagagaatttattcagtgtgatattgatatccttggttccgactctgctacatgcgagattgaattaattcatacaacagcaaaagcgcttcttaatattggtattaataattttaaagtaaagatcaatgacagaagaattttaagagaaattcttttatctgtaggttttgaggaagaacaattagacagtgtctgcatttcttttgataaattaaataaaatcaaggcagaaggtgttgaagcggaattaattgaaaaaggttttgacaaagatgttattgcagaatttatgaaactccttgctaatgcaccatttacacttgattatgtaaaagaaatctgtaaggataatgaatatgtagcttctttagcacatattatcgatacatctaatgctcttgcagatggaaaatatacagcagagtatgatatgacattagttagaggacagggatattatacgggaacagtatttgaagtagaatctttagattttaacagctctattgccggtggtggaagatatgataatctgattggaaagttcttaaaagaacagattccagcggttggattttctattggttttgaaagaatttacagtatcctgatggaaaaggaagcatataaaacagaaaaacagaaaaaagttgtcttgatttatgaagaagatcagattgctgatgctattcgttatgcagaaaatctccgtaaaacttataaaactgctttatatattaaaccaaagaaacttggtaagttccttaataaattagaagaacagggatttgatggtttccaggtgtttggaagagatgaagaagtaagaatgtttggaaaatagtagatttttgtaatgatttatggtatgatgttgcaaacatcaataaatataatcaggatgaaaggtcagaaaatggacggaagtatacaggtttattatggcaatggaagaggaaaaactacagcagctttaggacttggcattcgtgcagccggtgtaggaaagcaagttattatggtgcagtttctcaagaaaaaacattccgatacgctggatttcttaaaaaagttagagccggaattgcagattttccgctttgaaaaggcggcatgcgggtattctgatttgagcccgaaggaaaagcaggagcagatgctcaacattaagaatgctcttggatatagcagaaaggttcttgatacaggacagtgtgatctgctgattcttgatgagatttttggattagttgattataatatcattaccattgaagaattgatggatttgattgcagttaaaaaagattccatggatctgatacttacgggaagaaatctccctgaagaagtaagagagattgcagactgtgtctattcaatccaaagagaaaaggaaaaaaccccggagatattagcacaggggatttcctgatatattcttagatttagatgaagaaaggaaggataaggatggctgtttttacaggagcaggtgttgcaattgcaactccatttgatgaaaattacaatattgattatgaaagttttggaaagtttatagattttcaggtagagaataagaccgatgcgattatcgtatgcggaacctcaggagaggcatctactttaagtcatgaggaacatattgcagcgattcgctactgcgtaaatcgtgtaaacaagagaattcctgtaattgcaggaacaggttctaattgtacagatacggcttcctaccttacaaagcaggcacagaacgcaggagcagatgcagctcttgtggtaacaccttattataataaagcaacgcagaatggtctgatcgctcattatacagatattgcaaaacatacagatttgccaattattctttataatgtaccaagcagaactggctgtaagttagagtcttctacaattgcaaagctggtaaaagaggtagataatattgttggcgtaaaggaagcaacaggagatatcgctatggctgcacagatcatgtatgatacgcagggtgatattgacatgtattccggtaacgatgatatgattgttccgatgctttctatcggtggaaagggtgttatctctgttctttctaacgtagcaccggaagatacacataacatctgtgcagaatattttgcaggtaacgtagaaaagagtcgtgaattacagattaaatatcttgaactgattcattccctcttctgtgaagtgaatccgattcctgtaaagaaagcattagaattaatgggattctatggcggtaacgtgagacttcctttaacacagttagagcctgcccacacagaacgtctgaaaaaggctatgatcgacactggaattttaaaataaggacatattcggaggaatgaacataagatggttaaagtaatgatgtacggatgtaatggctatatgggtcatgttatctgtaatttaataaaagatatggaaaatgtcactgtggcagcgggaattgacccatgtccaggtgaccagaaggattttcctgtatttacatccttagatgcgtgtgatgtagatgtagatgttatcattgatttttctgcagcagtagccgtagatggtgttcttgattacgcagcagcaaagaagattcctttagtagaatgtacaacaggtctttcggaagaacagctcgcacatcttgaagaagccagcaaacagacagcggttcttcgttccgccaatatgtcacttggtgtaaacacattgttagagatggtaaagactgcagcaaagattcttggagaagcaggctttgatattgatatcgtagagaaacatcatcgaagaaagttagatgcaccttcaggaacggcattggcttttgctgattctatcaatgaagcagcggatggcaagtataattatgtatttgacagaagtgaaagaagaatgccacgtccagcagatgagattggaatttctgcagttcgtggaggaaccatcgttggtgaacatgagattatctttgcaggaacggatgaagtaattgaatttaaacataccgcatattccagagctgtatttggaaaaggagcggtggaagcagcagtatatctggcagataaaccagcaggtttatatgacatgcaagatgtgattgcagctaaatagattctgatttgtagatttaatgtagacgaaaaaagaaaaaataccatatcccagctgctctgtagtcgctgtgtttaagatgctcacccgcatcttaaacacgctcccaagccgcatctgggatatggtattttttcttttttctgactactataaatccacagttgatgagaaaggggattttccataaggttatggattctcaggaaattaaagcctaaaggattgacgcatttcttctggatgttttcatttgaataaaaagcttaatcccccagctatgctggggagaatagagtaagtggaaacgtagagtatacgatataatatttattccgaagtatagaaaaaaggtactgtatggaaaattgagtaatgatgtaagggaaatattatctacgctatgcaaataaaaattctcttttctttagaaaccttaatgcgattcagcaacatagaacaatttaaatgtcagtcttttagaaattaatttcccggaaagccatatccttctggtacattccacgttgctcaactgtagatttagaatagtcagaaaaaagaaaaaaataatatatcccagatgtggcttgggagcgtatttaagatgcggacaggcatattaaatacagcgactacagagcagatgggatatattatttttttcttttttcgtctacattaaatctacaaatcaggatttttttgtgaagtgagcggacttttttgttgtgctattgacagaaatgaaagtatataatatactctaacgcaaaagttttgatttcaaaaaaaagataaataattacgtttgaaatcaaaatacaactggtaagcgaaacaatatggtgtagaaaagaactgtaagtgagaactcgcatgcaaataggagggttagggttatgtcaaaaaagataagtgtaaagaagtttagaaaagtccttgttgcgaatcgtggggagattgcgattcgtattttcagagcgttaagtgagcttgggattacaacggttagtatttattcgaaagaagaccgttatgcaatgtttcgttctaaggcggatgagtcctatccgttaaatcctcagaagggaccgattgatgcatatcttgatattgatacgattattaagatcgcactttctacaggagtagatgcgattcatccgggatatggctttctttcagaaaatccggactttgcagatgcatgtgagaggaatggaatcgtatttattggaccgggcagcaatattatgaatgcgatgggagataagatttcttctaaaaagattgctattgaagcgaatgttccaattattccaggtgtggattatgcaattaaggaagtagatgaagcgaaaaaaattgcagcacaggttggttatccggttatgcttaaagcgagcaatggcggtggcggacgcggtatgcgaattgtaaatcaggaagaggatttagagaaagaatttaacgaagcgaagaatgaatcgaagaaggctttcggtgacgatatgatcttcatagaaaagtatttaagaggcccaaagcatatcgaggtgcagattatcggagacaattatgggaatgtagtgcatctttatgacagagattgttctgttcagagaagacatcaaaaggtagtagagtatgcaccggcattttccataccagaaacagtacgtcaggaaatctttgatgcatctatccgattggcgaaaacagtaggctatcgtaatgccggtacgttggaatttttagtagatgcagataatcatccatattttattgagatgaatcctcgaattcaggtagagcatacagtaagtgagatggttacggatatcgatatcgtacagacacagattcttattgcggaaggctatcctttagattcagaagagattgcgattccgtctcaggaaagcgtagtatgtacaggatattctatacagactcgtgtgacgacagaggatccagccaataatttccttccggatacaggagaaattacagtatatcgttcgggttctggtaatggcatccgtcttgatggaggcaatgcatatacaggagcagtgatttctccatattatgacagccttcttgtaaaagcaatctctcatgacagaacttttcttggagcggtaagaaagtctatcagagctttacaggaaatgcgtattcgtggagtaaaaacgaatattccatttcttgtaaatgtgttaaatcatccaacatttcaaagtggacagtgttatacaacgtttattgaggaaacaccggaactttttgaacttactaagagtcagaatcgtgcgaataagattattgaatttattggggatcgcatcgtaaattcaaataatggagaaaaaccattttatgagaacagagttcttccgaagcttgacaaaagcaaaccagtttatggagcgagggatgaatttttaaaattgggtgcacagggatttatgcagaagattttaaaagaagataagctttatgtgacggataccacaatgcgagatgcgcagcagtcactgatggcaacgcgtatgagaagtaaggatttgtgtggtgcggcttatgcgacaaacgcgtttatgcagaatgcattttctgtggaagcgtggggtggtgccacctatgatacggcatatcgctttttgaaagaatctccttggaaacgtcttgagttattaagagaaagaatgcccaatacattgattcagatgcttcttcgtgcatccaatgcagtgggatacagcaactatccagataatgttgtaaaagaatttatccgtatctcagcggatcaaggtattgatgttttccgtatttttgacagtttaaactgggtggaaaatatgaagatgccaatagaggaagcgctgaaaacaggaaaaattgttgagggaactatttgttatacaggagatgtcagcaatccaaatgagacaaaatatacacttgattattatgtaaaaatggctcttgaattagaaaaactcggatgtcattccattgctattaaagatatggcggcacttttaaaacctagagcggctaaagaacttgtaggcacattgaaaaaagaacttcatgtaccattacatttacatacacatgattctacaggtaacggtgtgagtacagtgctcatggcagcggaggcaggagcggacatcgttgacttagcgattgaatctatgtcatcgatgacaagtcagccatccatgaatgcggttgtagaagcgcttcgtggaacaaagagagatacagggcttgattttgaagagttgtcagaactgagcagatattataatcgaattagaagtgtgtatgcaccatttgaaagtgatatgaagtctccgaatacggagatttataaatatgagatcccaggtggacaatattctaatcttcttgcgcaggttacagaaatgggatctccggaagaatttgaggcgatcaaagggctttataaagaagcgaatgatttgcttggtaatattgtaaaagtaactcctacttcaaaggcggtaggtgatcttgcaattttcatgtataaaaataatctgaataaggataatattttaactgccggagctagtctgtcttatccggattccgttgtttcttattttcagggaatgatgggacagccttatggtggattcccgaaagaattacagaaaattgtgttaaaagatattgaaccgcttacagaacgtccaggtaaattgttaccgccagaagatttggaaggtatcaaaaagcacctcattgaaaaataccattatgaggataaatcagaagaagttatggcgcaaaaagcaattagttatgcattatatccaaaagtgtatgaagactactgcgaacattttgaaatgtataatgatgtgacaagattagaaagtcatgtgtatttctatggcttgagaaaaggagaagaaacatacttaaagattggtgaaggaaaagaacttctgatcaaatatcttgaacagagcgacccagatgaaaatggaatccgaacattaagttttcaggtaaatggttctattcgtactgtgaagattcaggatcataatcttgaaattaagacagaccgccgcttgaaagcagataaaaataatccacagcatcttggctcatctattccaggaaccgttgataaagttcttgttaaagaaggcgatgtagtaacaaagaatatgccgcttatgacaattgaggcgatgaagatggaaacaacggtagtatctacggtaaacggaacagtagacaagatttatgttgagtcaggggacagtgtacatcaggatgatttacttgtatcatttcatattaaagaatgattttacggaataactgcaaaaaacagatagtgatttgcaataaaaaacggtaataaaataaaaaagagtcttttcgataactcctttttacattgacacaaatagaagcttgtattatactttcccgtaaaatttttatctcagtcgagagaaatccttataagagaagaagtggcagacgtgttagaacagaaaaagaaacaggataatttgattatatttattcaggcaatgaaacaaaagttatataagacaagctttgaaaaacttagtgttggtgaaatcgtaaaagaatctggtttgagtagacagacattttacagaacctgtgagaataaatatgatttagtaaataaatatttaaaaaagattattatagaaacatatagtacgattgggacagagagtacattccggaagagtcttgagaacaagtttcgaaagatgcttccggaaagggagttacttgctgtagcatttcaatcaaaagaatatgatggattatatcaattcacacacagattgattttagattttcacaaaaattttatagaaaagcaggagaaaagatctcttgatgaagaggaaaagcatttgcttgatatgtattgcgaagcatccgtatacatgactatgaagtgggcaacaaaggaaatggaagcaacaccacagcaaatgtcaagattattagtagatgcgatgcccctaaagttgcaaaaggtttataaaacagtggaacaaacagagtaatttataacatgtcggggtacagatagatggttttgtaactaggctgttaattgaaaaagttttataattaattacggattatctcatgcatattttataaaaaataaatggtctcttttatagaactctcacatttataccatttattatggaatatgataatttgaaacgaggagaatgaattatgagctgcaacacaaatcaaattgaagaactagtaaagaaaatcgtagcagaatataatacgactggcgcaaagacagaagagtatggttatggaatttttgatacaatggatgatgctgttgaggcatcagcaaaagcacagaaagaatatatgaatcattcgatggctgatagacagaagtatgtagaaggtatcagagaagtaatctgtgaccagaagaatcttgattatatgagtaagctcgctgtagaagagagtggtatgggatgttacgagcataaaaagattaagaataaactggcagcaatgaaatctccgggaattgaagatcttgctacagaagcattcagcggagatgatggacttactttagtagagtattgtccgtttggtgttattggggcaatcgcaccaacaacaaatccaacagagacaatcatttgtaattctattgcaatgcttgcaggaggaaatacagtggtatttagtccacatccacgttcaaaaggagtttctatttggctgattaagaagattaatgccaaacttgaagaattaggagcaccgaataacttgatcgtaacagtaaaagaaccttctattgataatacaaatattatgatgaagcatccaaaggttcgtatgcttgttgcaacaggtggacctggtattgtaaaagccgtaatgtctacaggaaagaaagcaattggagccggtgcaggtaatcctccggttgtagttgatgaaacagcagatattaaaaaagctgctgttgatattgtaaatggttgttcatttgataataacctgccatgtatagcagaaaaagaaattgtagccgttgatagtatagcagatgagctgattgctaatatgaaagccaatggagcttatgagttaaaagacccggctattattgaaaaaatggtagatatggtgacaaaggatagaaagaaaccgcaagttggttttgtaggaaagagtgcacaatatattcttgataaagttggaattcaggtgggaccagaagtaaaggtcattcttcttgaagcaccaaaggatcatccatttgtacagattgaattgatgatgcctattcttcctcttgttcgtgtaccaaatgtagacgaggcaattgattttgcggtagaggtagaacatggaaacagacatacagcaatgatgcattcaaaaaatgtagataagcttactaagatggcaaaagacattgaaacaacaatttttgtgaaaaatggaccttcttatgcaggaattggtgtaggcggaatgggctatgctacatttacaattgctggaccgacaggcgagggattaacatctgcaaaatctttctgccgtaagagaagatgtgttgttcaaaatggtggacacatcagaaataaaaatggtgaattataaaaataaaaatccaaaatacgcataaaaacaatcaatgaaaaacaagtaagaaaaaagaaaagcaacaatcaataataatacaaaatatccttcttaaagttttcgatgtgcaaaaataacctcagccgcaatcgttgaaattagcggttggggttattttttactataattattataattttataattgtaaaaaatataaaaaatgacattaaggttaaaaagtattttttacacataaagctccccagccgattttttcattaggatattcagaaaaggcgggtaaagctcttgcacttttccaaaggtatgcctttagtttttcaccataaagaaaagggtcattgccttgtacaatgccatattgcattaaaagtgcagcggctccggcaacaaaaggcgatgccatagatgttccggtttgtatagtatatccccctccgggagcggtgcttaatatatttactgccggggcacaaagatcaggttttgtatacatagtattagaaaaaccctggccagaaaaggaggcaaatatatcaaggctgctgtcgtagccgctgacactgattacggaagatgccgtagaaggaatcgtgaaagtcatgtcagaagaaggtgttgtaaagcctgtagcggaattcgtagcatcttttgagggcaaccagaattgtagccgcccatcaacaatttttcctgttggaatggacatgatccgtaatgtccaggtaccagaaggaataaaggaagtatttggactaaaagaaagaaaatattgtcgaaatggctgatagggtgtggggttgttaatagtaagataaatggttgtatccgcaatcatataagtgtagataccgggcgtagcaggaaaggtaaaactttgtgagccagaaggagcgagaagttcataagaaaaatcatctgcaaagacctgccatatttccagataaagactgcgctcaccgggagctatagtaaaagagagggatttcttataggagcttttggttaaagaagacccaatatttaaagaagcgtgtcttcttgtgcgcccttcgtttcctgtagcaacagaaatgatgtttttgccataaaaagaaacctgttccataaaaagttctaaaagactgttcccagtatgagaaccatcatttgaaccataactgatattgatacttaacggcagaaaaagggaattcgtaaagcgaacagcaaaatcaacagccatcataagattagcgtagtcgctataaacagaagaagcatcgttttttaattttacaacaatcagagaactttcaggagcaactccctgattctttccattactgactctgccatttccggcacagataccagcaatgtgagtaccatgaccggaattatcttctgaaggagaaagtgattcagaagcagacccaagtgcagtcggggtggaagaatcaaaaaatgaaaaattatttgcgcctgtaagcagttgatttaaatcttcttctgaaaaaataattcctagattataaggattatttatggaaaaatgattgtgaataaaaggcagactttgatcccagtaagccaaaatacgtgtgcttccgtcagtgtttctaaaatcagggtgtgtataatccaccccagaatcaagaatagcaataacagtccctttgccggtgagagtcgtttcattaacatttcttccggtaataatattgtaatcaggtaaacaagaagaagcgataccggtaagagcattttcataaatcggacgggaaagttcaacataaagaacctgaggataagctaaaaaagcaggaagatacttctcttgaataaaaagaatggcaaaattaccgagtaaaggaataaaagaaaaaggaatttctttctgtatttcttcaagagaaccattataaaaaagaatcagcttccatgtatttatatcgggggaaaaaccagaccaaagccagggactttccattcgtttggtatcatctaaagaaagcgagagcgcaagcgcaggatttaatttctggtttataggttttatttcagtaatagaaagcataatgaactcactttaaatctttacaaaaatatattcattaagtaactatttaattcattagaagaaaacagacgaaaaaagaaatactgccatatcccacctgctctatagtcgctgtgtttaagatgcttgtccgcatcttaaacacgctccgaagccgcatctgggatatggcagtatttcttttttttgttttttggcaggataagggggagaagtcagaagtcttctacttgctcggaagatgtatcgtccagacgattattttctttctataacgagtagaaaagaaaaagggcttatcatcagtgaaacttaaaaaaagtcagcatagtggagagagtatcgcaaatgtaatgtgggagcaagtaaaaatgcggacaggcatactttctgggtagcagtagacttctgatttcttccccttatcttccccaaagactattgtattcattccttctggagccaacaaacagaaaataaaaatactagaccatcgcaaatgtaatgtgagagcaagtaaaaatgccgaacaggcattttctacgcagtgatatctttacagttgcgatggtctagtatttttattttcgtctgttccctaatgaattaaatagtaaaatgtgttatagttggagtgaatttgataaaggatggatgaaagttatgaaagcagtattacaggtagtttctcatgcgacagtttgtgtggaaggagaagttacaggacagattgataagggattattggtttttcttggtgtggctgaggaagatgagcagacagatcttgataagattgtaaagaaggtaacagagctacgtatttttaaggatgatgcaggaaagacaaacctttcccttcaggatgtgggagggggacttttagtggtttctcagtttaccttgcttgcagattgtaaaaagggaagacgaccaagttttgtaaaggcgggaaatccgcagaaagcggaagagatgtatgaagagtttatacgggtatgcaaggaaaaggtttcgaaagtggagcatggtgtttttggagcaaatatgaaagtggaacttttgaatgatggtccgtttacgatagttttagacagtaaagagttataaatatgaattattgtcggaaaaaacttgcattttatatgcgctttactatataataacggatagcaggttttgaagaataatttcctatttttaaataagcagaataggaatacgttaagtgaaatagaagggagacatacgatggataagattaagatgactactccattagttgagatggatggagacgagatgacccgaattttatggaagatgattaaagatgaacttcttcttccttttattgatttaaagacagaatattatgatcttggtcttgagtacagagatgagacaggagatcaggttactgtagattccgcattagcagcaaagaagtatggtgtagcagttaagtgtgctacgattactccgaatgcagcccgcgtaaaagagtataatttaaaagagatgtataagagtccgaatggaacgattcgtgcaattttagatggtacagtatttcgtgcaccgattgttgtaaaaggaattgagccaacggtgaagacatggaagaagccaatcacaattgcaagacatgcttatggagatgtatataaagcttctgaaatgaagattcctggaaagggaaaggcagaaattgtttatacggcagaggatggaacagagacaagagaattgatccatgagtttgatggtccgggcattgtgcagggaatgcacaatctgaatggttcaattgatagttttgcaagatcttgttttaattatgcattagagacacatcaggatttatggtttgcgacaaaggatacgatttctaaaaagtatgatcatacatttaaagatattttccaggatatttatgatgcagattataaagagaagtttgaggaagccggtattgagtatttctatactttaattgatgatgcggttgccagagttattcgttccgaaggtggatatatctgggcatgtaaaaactatgacggagacgttatgagtgatatggttgcaactgcatttggttctcttgctatgatgacttctgtacttgttgcaccggatggaacaacagagtacgaagcagcacatggtacagtacagagacattattataaacatttaaagggtgaagaaacttctacaaactctgtagcaactatttttgcatggtcaggagctcttagaaagcgtggtaagttagacggaattgatgagttagtatcatttgcagataagcttgaaaaagcaacgatcgatacgatcgaaggtggtacaatgacaaaagaccttgcgctgattacaactttagagaatgttacgactgtaaatagcgaaggttttatcaaggcaattcgtgcgacgttagaaaaaatgttgtaatttacagaaaaatacgttatatataataagatgcaaatataaaaccatggaatccttagcatatggtatacaaaaaaacatgaacaaaataagcaatgtgctgttttttgtaaattagttttagagtgttacaatgaacattacgaaaggataccatggttttgtgctgtgaataaataatagagataattttttagaaaagaggtagattatggagtttcagcctgtaaaggcgagcgataaagcagttatcgatcgatatatgaagaaggcaaattcacgtagctgtgatatgtcttttgcagccgtatatctttggaaagacttttatttactggaatatacagtgtgtgaagatatgttgatttttcgaacaactgaagaaggaagcagttatagttttccgataggggatgcagatcctggaaaggcactgcttgcattggaggaacactgcaaagcaaatgaagaggttttgaaactgcactgtgtatatagagaaaatgaagcgtggcttgaagaacatatgcccggaaagtttgagatagaatttgacagggacagtgcagattatatttatgaatgtgaaaaattaattggcttaaagggaaagaagttccatggcaaaaagaatcatgtgaataaatttaccaagacgtatgactgggtttatgaaaaaataacagaagagaatatagatgattgccttgccatgttatataagtggaaagaaaaaaactgtgagccgggtaatatagaaaaacatgcggaagcctgcgtgtcagaaaatgcattacgaaaaagggaatttcttggcttgaagggtggtctgcttcgtgcaaatggtgaagttgtagcatttgcgttaggagaacagattaatgaggatacattagttgtccatattgaaaaagcattttcagaagtgccaggagcctatgcggtgattaaccagcagtttttgattcatgaatctggtggattaaagtatgtaaacagggaagatgatgtaggagagccgggacttagaaaggcaaagttgtcttatcatccggagtttcttgtagaaaaaggttttgcaaaacgaatttaaaagtatgggagtaatagccgaaagcgaagtgtaattccgttgtgaatgggacggaaaagaaaaaatgcaaaagagttcccttgacaggaagagaattaaaggatatagttaaaaaaattaactggcaagggagctggtcataacgaaggaggtcattatgagacatttaatagatccgatggatttatctgtaaaagagattgaacatttattagatttagctgatgatattattcttcataaggagaagtatcaggaagtttgtaagcataagaagttagcgactttattttttgaaccaagtacaagaactcgacttagttttgaagctgccatgatggagcttggcggtaatgtacttggtttttcttctgccaattcttcttcagcaacaaaaggagagagtgtttctgatacagtaagagttgtatctggttatgcagatattattgcgatgcgtcatccaaaagaaggtgcgccatatgcagcaacaagaaaggttacagtgccaatcattaatgctggtgatggagggcataaccatccaacacagacattaacagatcttatgactataagaagagaaaaaggacggcttaataatctgacgattggaatgtgtggagacttaaagttcggtcgtacggtacattcattaattaaagcgatgtctcgctatgagaatatcaattttattatgatttcaccggaagaattatgtctgccggattatattatcaaagatgtttttgaaaagaaaaacatcaaatataaaaacgtaagaacaatggaagaggttatgccggaattagatattctttatatgaccagagtgcaaaaggaaagattctttaatgaggcagattacattcgtttgaaagacagctttattttagatgagcgtaagttagtagatgcgaagaaagatctttgtatcatgcatccgctaccacgtgtgaatgaaatctctacgaaagtagatgatgacccacgtgcatgttattttaaacaggcattgtacggaaagtatgttagaatggcattgattatgacgttattgggggtaagcgcagatgaagatagatagtattcagagtggaattgttcttgatcatattaaagcaggaaagagtatgcagatttacaaatatcttggattagatgatttagactgcagtgtagcgatcattaagaatgcttccagtagcaagatgggaaagaaagatattattaagattgcagataatatggatttgaatttggatgttttagggtatattgatccagatattacggtatgttatatcagagatggaaagatcgtagaaaagaagcatcttgaattgccagaaagaattgtgaatattgttcgttgtaaaaatccaagatgtatcacatcggtagagcaggatttagagcaggtgtttaagttgacagacagagagaacagaatatatcgctgtgcttactgtgaatctaaaaaaagtgaatattaatttagaagaatctaaaggagaggtcgcgcaagaatgtgcggcctctattgcatcttgtgacgatttggtgtacaattattctacttttattttattatatcttatgagaagtgtggtgagaaagcaatggaggcccagaaacaaaagttaaaaagaacacaaaaagagatcagtaagccggaagatttcaccgatccggaagtcttatacgataagttgataaccacgattcgggagtatcatccgtcaacagatctttctatggtggagaaggcatataagttagccagggatgcccataaggatcagaaaagaaagtcgggggagccgtatatcatccatccgctctgtgtagcgatcattcttgcagagctagagcttgataaggagacaatcgttgcagggctcttacatgatgtggtggaagatacaacggcaacgttggaagatttgtccagagaatttaatgatgaggttgcattgttggtagatggtgtaacgaagctgggacagttatcttattctcacgataagatggatctgcaggcggagaatttacgaaagatgtttcttgcgatggcaaaagatatccgcgttattcttattaagctggcagaccgtcttcataatatgcgtacactgcagtatatgaaaccggaaaaacagaaggaaaaagccagagagacgatggatatttatgcaccgattgctcacaggcttggtatttccaagataaagacagaattagatgatttgtctttaaaatatctgcagccggaagtttataaagatcttgaggaaaagttacagacgaacaaggaaggcagagagaattttattcagtcgatcattgatgatgtcagcaagcatattaaagatgcgggaattcgtgcagagatagacggaagagttaagcatcttttcagtatttataagaagatgcgtaatcagaataagacgcttgatcagatttatgatatttttgcagtaagaattaaagtagatacagtaaaagactgctatgcagctttgggggttattcatgagatgtataagccgattccgggtcggtttaaagattacattgcgatgccaaagcaaaatatgtatcagtctttgcatacaacattaattgggtcatcaggaacaccgtttgaaatccagattcgtactttcgagatgcaccgtactgccgaatatggtattgccgcacattggaagtataaagaaggtggcggcaacattaataaagaagaggaaaagctgagctggcttcgtcagattcttgaatggcagcaggatatgtcagataacaaagaatttttaacaatgttaaagacggatcttgatttgtttacagagcaggtatattgttttactccgcaaggagatgttaaaactttaccggcaggctctacaccgattgattttgcttatatgattcatacagcggtcggcaataagatggtaggagcaagggttaacggccgtcaggttcctattgattataaactacagaatggtgacagagtcacgattgttacttcgcagaattcgaatgggccaagcagggactggctttctattgtaaagagttcacaggcaaagacaaagattaatcagtggtttaaaacgcagttcaaagaagagaatatctcaaaaggaaaggaactgcttgatcggtattgtaaggcaaaaggacttgtgatatcccaatacatgaagccggagtatcagaagaaatgtatgcataaatatggtcttaagaactgggattctattcttgcagcaatcggacatggtggattaaaggaaggtcaggttattaacaagctggtagaagaatatgaaaaggaaaaccagaagaagctgacagatcaggatgccctgaacgaaatagaagagaagaataagacaaaggctgttgagaaggccagaagcaagtcaggaattacggtaagaggaattcatgatgtgtcagtacgcttttctaaatgctgcagtccggtaccaggagatgaaattattggttttgtcacaagaggaagaggaatttccattcatagaacagactgtgttaatgtgctgggtatgccagaaagcgacagagcaagattaattgatgcagagtgggaagaagaagcggtagaaaaaggtggagagctttatatgacagaaatctgtctgtatgctcacaatcgtacaggaattctgcttgatatttctaaagtttttatggaacttaaggtggacattaaatctgtgtcaacgagaacaagtaaacaggggttagcaactatcgttctttcttttgaaataggaggaatcgatgagttgaatcatattattaaaaagcttcgaaacattgaaagtgttatcgatatagaaagaagtgctggttgatcagcggaggtatttttttatgggacagttaaaaatcgtttgtgcacagttaggaccaattgatacaaacacatatattttaatggatgatgaaatcaaagaagcgattgtcattgatccggcaggaagcccggaagagataattaagtttttggagaatgaaggatattctttagacggcgttcttctcacacatggacatcatgaccatattggaggattagaaggtttaagagaacattatgatccttggaaactgcgtgtgtatgctgcaaaaccggaacaggaagttcttatggttaaagattataacctaagtccgatgtttggagagggatatacgacacatgccaatatgatgatcaatgataaacagatttttgaagtgacatccaaacataaatgtcagtgtttatatacaccgggacatacagttggaagctgctgttattattttgcggaggaaggatggcttttctcaggagatacactttttgcaggaagtgtcggaagaagtgatttccctaccggagatgcacagacccttcttaaatctctgaatcatgtagtgatgaatcttccggatgaggttattgtatatccgggacatggtccatctactacgattggtgaggaaagggaaacaaatccatttgtagaaagataatatagaaaagatagagaagtatagaaaagtatagaaaagatagaatagaaatgatttatttaatacaaaatgatcaggaatatgattatgacgtgcgggctacggcactggccttttttgaacggaccaaaatagtagaggtgacaaaagaagagtttgaaaagcaaggatgggagaaggatgaccttctcctcacgcttgtctatacgaaaaactgtattcaaggaacattggagaacaaagagggtaagataatttctgaagaaataatctgtgactatagtgatcataaaaacagtcgtaatgccgtatgtcgctttttatatcgtttgtttgaaaagtttaccggaagaagtcttccctgggggatgcttaccggaattcgtccaacgaaaattattatgaagtggatggaagaagagaaagatgcgaagaagctggaacagcgttttagagaaacgtatcttgctgatgcacaaaaggcgaatctttgccgcagagtagcgcagaaagagaaggtattattggaatcaagaccatttgaaaaagagtatagtctttacattggaattccattttgcccgacaacatgtctttactgttcttttacctcatttccggtggctcgttttggcgacaggatggatgcatatttagatgcattatataaggaacttgcttttgtggctgaacatcacagggacaaaaaacttacgacgatttatattggcggaggaacacctacagcgctaaatgaaaaggcgttattaaggctgatgcatatgattcatgagctttttccagtggaagaaacagaagagtttactgtagaatctgggagacccgatagtattacaagagaaaagttctgcattttaaaagaagcaggagtaacaagaatttctatcaatccacagacaatgcatcaggaaacacttgatctgattggtagagcacatacggttgtgcagacaaaggaagcgtttttattagcaagagagtgtggatttgataatattaatatggatatgatcacaggacttccgggagaggacatttcccatgttcgtgcaaccttagatgaaatatttgcgctccgaccggaaagtcttacggtacattccttggctataaagagggcggcacatcttaatatggagatggaaaagtatcagaatatggttaagggcagtacgaacgagatgcttcgactagtagatgaatatgccagcaacatggggatgaaagcgtattatatgtaccggcagaaaaacataccaggtaatcttgaaaatattgggtattgtgtttcaggaaaagaatgtttatataatatcttgattatggaagaaaaacaggatattatttcttgtggagcaggagccagcagcaaatatgtatttgcagataacagaatagaaagaacagagaatgttaaaaacctggatcattatattaaccgaattgatgagatgattgatcgaaagaggaaatatctctaaaataaaagaggagatactatggcatttgattatgatgggacgcatgatctggagacatcattgcaggattcctttggagaagcaattgttcatgggatggttgtcagtaatctggcatcgtttgtggcaaaggaaatggcgctttcagaagaacagtgccataactttgcagtggcaggaatgctgcatgacataggaaaattgcgtcttcgttcttatgtatatgaagaaaaagaagcaaaactaaatatagatgaactaaggtatgtaaggctgcatccttctttaggatatgctatattaaaagaacatggatattcggaagaagttttgtcagcagtgttatatcatcatgagaatgcagatggaagcggttatccgaataacctaaaaggggaagagataccgttaggggctcgtatacttcgagtatgtgatgcatttggagccttgatagcgaatcgcccatataggagcgcattcgatatcgaaacggcaatatctattatgattgaagaagtgaaaaactttgatatgagagtttttttaacttttcaaaaagtaacccagtctgaaaatatgaaaaatatgttgacgaatctgggaatatattaatatattattttactgttttaggaggaaaataaaatggctgaatccatgaaaggattgaaaagatcccatagatgtacagaagtatccagtgaaaatattggagaaactgttaccctgatgggatgggtacagaaaagaagaaatctggggagtctgatttttgttgatttacgtgacagaagtggattgatccagttgtattttgaagaagaaacaattggtgaagaaggttttaaaaaagcaggttctttaagagcagaatttgtaattgctgtaaccggaacggtagagaaaagaagcggagcggtaaacgaaaacctcgcgacaggagatattgaagtaaaggtagaaagtattcgtattttatctgaatcagaaactccgcctttcccaattgatgcggatattacagtaaaagatgaacttcgcctgaaatatcgttttcttgatttaagacgtccaaatatccagaagaatcttatgatgcgaagcaaggtagcaacacttacaagacagttccttgcgaatgagggatttttagaaattgagactccgatgcttacaagaagtacgccggagggagcaagagattatcttgtaccaagtcgagtgcatccaggtagtttttatgcgcttccacagtctccacagctttttaagcagttgttaatgtgttccggttatgatcgctattttcagcttgcaagatgtttccgagatgaagatttacgtgcggatcgtcagccggagtttacacaggttgatatggaattatcttttgtagatgtagatgatgttattgatgtgaatgaaagactgcttgcatatttattcaaattatgtctgaatgtagaagtgactcttccaattcagcgcatgacatggcaggatgcaatggattactatggatctgataaaccggatcttcgttttgacatgaagattcaggatgtatccgaacttgtaaaagactgtggatttggtgtgttctccggtgcaatcaaagatggcggtatggttcgcggactttgtgcaaaaggacttggagatgtttctagtaagaagatgaaacatatcgagaagacagcaaaagactacggtgcaaaaggattagcatatattcagctcaaatcagatggaacagtaaaatgcccattctctaaatttatgtctgaagaagagcttcagtcacttattcaggctatgggtggtgaaaccggtgatttattagtatttgcagcagataaatttaaagtagtatgtgatgtactcggtgcacttcgtctgaagtttgcagaggaactgaatcttcttgataaatcagattatcgttttgtgtggattacagaattcccgttactggagtggtcagaggaagaaaatcgctatactgcaatgcaccatccattcactatgccaatggaagaagatttagatatgattgacacagaaccaggaaaagtacgtgcaaaagcatatgatattgttttaaatggtacagaaatcggcggcggtagtgtcagaattcatcagaatgatattcaggaaaaaatgtttgaatgtcttggaatttctaaagaacaggcacaggaaaagtttggattccttttagaagcatttaaatatggtgttccaccgcatgcaggacttgcatatggtcttgaccgccttgtaatgcttatgacaaaagaagatagtatcagagacgttattgcattccctaaggtgaaggatgcttcctgtctgcttacagatgcgccaaatacagtagatgataagcagttagaggaactttgtctcgaaattgagattccggaaaaggaataataatttcgtctgatagactgacagacgaactccagaaataaaaagatccctatttgtgactttcgtcgcggcgtgttgaatgttcgcttaagcgttcgcatccaataattgctcccgggttacaaatagggattcttttatttctttttttaaatgatttggttacagaagactacaataaaggttaattgctggtgtggaaagatggatttcaagggtagtggccttccaaaaacattggaagaatatatcagatttatagagtttgaaatggattttctagaaaaaagaaattgtagaattaaagaattttgtgggaacgaaagatgaactaagacggtgtgaaaatgcaaataaaaacatagaatgattcaggattacgagagtagcgttagctatgaagtaattctcgtgccattatagaatagatataatatctagcgctttttgtaaaaaagaaaaaataataaaaaaagcttgacgtaattatgttgttgtgataagataatatacgttgcacatgagaacacattgatttgaaagaaattggaaagaaaatcttcagataaatgaaaaaaatcttgacaagataaaacatgtgtgataaaatataaaagttgcacgacatgaaaagaacaacttcttctgaagaagatagaagaagaaagtaagatagcttcgaaaaagaagttaaaaaacttgaaaaaagttcttgacaaacaaaagtcgatgtggtaaaatataaaagctttcgcatgaaagcgaaaccttgataactgaataacaaaacaaccttgaacgttaattcaaatttcattcgggttttcttgagagtgatgtctgcagggaagtccatggaacagaacgaaagttcaaaacctaaataaacagtaaagacaggaaaagaaccagtggttctggacctcgatctgacatcttaaacactttatttgag

SEQ ID NO: 434 - DNA, 29775 bp, Eubacterium hallii
gaaagagctaaagcagacagatttaaaacagatagagtttctgggagggaagaaggcagaggaaaggcaaagaagaagacgatccgtaacgttcataaaaagaagaaacgtggataggaggttaccagatgaatataggaatcattaccggtgcttcatcgggaatggggaaagagtttgtgaaactgacgatgcaaaatcacctggaattagatgagatatgggtgattgccagaagaaaggaacgtctggaagcctggtcagatctttataaagaacagaagtttcgtattcttccccttgatcttcaaaagaaagaagatatggattatcttggaaagacattggaagaagtacaatcacatatcgaattatttattcactgcgcgggatttggtattatgggaaggattcaggagatttctatggaagagcaggctgagatggtagatgtgaactgccgaagtgttgttgaggtgtcctcacttgtacttccttatatgaaatacagaggacgaatgatttatatggcatcagcagcagcctttctccctcagccgggctttgcggtatatgcggcaagtaaagcatttgttttaagttatgtgcgggctttacgtgcagaaagcagagaaaaacagcttcgtgtgacggcagtatgtccgggagcggtaaaaacagaattttttaatcgtgcacttacgaaaaaacatttgccagcatataaaaagctagtcatggcagacccgaagaaagtggtaaaaaaggcctggaaggataatgagaagaataaagaagtttccgtatacggaacagtgatgaagcttacacatctggtaacaaaattacttccacacagtctttttttgcaatttattggaaggaaataaaacaaatgaaagaagtaacaattacaaaaagagaagaaggacagcgttttgaccgatttcttggaaagtatcttccgggagcttcctccggttttcttcataagatgctcagaaagaagaatattaagcttaatgggaaaaaggcagaaggacgggagaaactcagtgctggagatttaattcagattttcttttcagatgagacatttgagaagtttcaaaaaccgcaggaaggtggaaaacaggacacatttacagacggcaagagcatagtacagaggacgcagggaaaacagctagaaagaacaaaacaaaagaaaagactgacaaaagaagagatgaatcttcgagaacaggtaaaagttctctattcttccgaagatattcttgtatttcacaaaccggcaggaatgctttcacaaagagccaaagcagatgatgattctttaaatgattatctgatcgattactgtgtaaagaatggaattatttcacgagaggagctggcagcctttcgtccgtctgttgcaaatcgtcttgaccggaatacaagtgggattgttcttgcaggaatttcaattagggggcttcagaccttatctaccatgttaagagagcgtactcttggaaagtattacctttgccttgtagagggaagagtaaaagaagatgctcgtatttcaggttatctgacaaaggaagaaaagaataataaagtatcacttcataaagaaaaggtagaaggagcatcgtatatcgagacagagtatacggttcttaaaagtacggaaaaggcgagtcttttaaaaatccgtcttattacaggaaagagtcatcagatcagaggacatctagcttctacaggacatccagtgtttggtgattataaatatggtaatagagagtttaataatcagattaaatggaaagagggaattaactatcagcttttgcacagttatgaattgattgtgccggaaggaacaggagaactttcaggattacacattattgatccggtgccggaagcctttcatcaagttcagaaaaattggaatttagaattttcaggactttcttataccaagacctcccaccaaactgcttctcgtttggataagagaaaaaatgacagagagggacggaagtaatggcaacctggaattcaagaggacttcggggttctgtcttagaggaactgatcaattatgcgaatcaaaaatacaaagacaaagacctggctcttattcagaagattcctacccccattacaccagttcgttttgataaagaatccagacatatcacgcttgcctattttgaaaagaaaagtacagtggattatattggggcagtgcagggaattcctgtttgctttgatgcaaaggaatgtgctgccgatacgttttctttacagaatttacatcctcaccaggtagagtttatgaaaaattttgaaaaacaaaatggaatcagttttttgttgatctactatacacatcggcaaaaatgttattatctgagattctcagaaatgatgaagtattgggagcgaatggaacagggaggccctaaaaattttaaatatgaagaattatctccagctttttttgtgccggcaaccggtgggattgcattacattaccttgtagcaatgcaggaagatttaaaagaaagaagtattcggtagattgacgaaccttcatttttcatatataataagactttgtaaaattttgaggattataatgtttttagatatgaggtgagagaaaagtgattaagagcatgacaggattcggacgcggggagagtgtgtcagaggactgtaaggtaactgtggaaattaaagcggtgaaccatagatattgtgatctgaatatgaagcttccaagaaagcttaattatttagaagcggatatccggaactttttaaaacaatctattcagcgtggtaaggtagatgtttttataaattacgaagatttatcggcaaaagatgtgaatgtccgcctgaatgaagagttgggcagagagtattatgccgcactgacaagattaggcgaaacgcttgggatttcaagcgaagtgaccgcattacagattggaagatttgctgatgtacttacgttagaagatgtgcctgtgaatcaggattcgatcaaagaacagattatggaagctttaaaagaagctacgaatcacttttctgccagcagagaaaaagaaggcgagaatctcagaaacgatattcttataaagcttgatgaaatgaaagagaatgttacctttatcgaagaaaggtatccggcgattgtcagtgaataccgtaaaaagttggaagataaagttgcagaacttctagaagactctaatatagatgagagccgtattgcagcagaagttgttatctattcagataagatctgtgtagatgaagagactgtccgcttaaagagccatattgatggaatgcgtgatgaactcttaaagggcggtaatgtcggacgtaagctcgactttattgcacaggagatgaaccgagaggcgaacaccattttatcaaaggcgaatgatatcgaagtgtcagatcatgcaattgatttaaaaacagagattgaaaaaattcgtgaacaggtgcagaatatagagtagacggagagagaatggcagattttattaatgtaggttttggaaatatggtgaatggagataagattatttccatggtcagtacagatgccgcgccagtcaaaagaatgatacagaatgcaagagacgaaggaaaggcagttgatgccacctgtggacggcgtacaaggacagtacttgttatggaaagtgaccatcttattttatctgcccttacgacagatacgttatcttccagatgccataataaacgcagtgatgaggatgaggaaaatgaaagataagggaacattagttgtaatttccggattttccggtgcaggcaaaggaacagtatccaaagctctcgttgaaaagtttggatacagtctttcggtttcggcaacaacccgtcagccgagagaaggagaacaggacggaagagaatactactttaaatcagaagatgatttcttacgtctgatcgattataatggatttattgaatacgcacagtatgtagatcattattacggaactccaagaaagtttgtagaagacgagcttgaagcaggacatgttgtgatccttgagattgaagtacagggtgcgatgaagataaaggagcagtatccggatgcaattcttttatttattacagcaccatcaatcgaagtacttaagaaccgtctgatcggacgaggtacggagacagcagaagtcgtagagaagagaatgcgaagagcagcggaagaagcagaaagtattgaacagtatgagtttatcgtcagcaacgaagaaggtaagcttgaagattgtatgaatacgattcattctattattgaaagcgagtcctgtcgtattacaaagagacaggaatttgtagcaagtcttcgagagggcttggaagaatataaagaaaacaccgataaagacaaataagacaaagagaaaggagacttattttatgttacacccatcttatacagagttaatggaaaagattaataaagaaggcgaacagggagaagaaccggttatcaacagccgttattctattgttattgcaacttctaaaagagcaagagagattattgcaggtgatgaacctttagtaagtggaatggaaggagagaaacctttatccattgctgttaaggaattatatgattctaaacttaagattcttccgggagatgatgttgttgaagatgaagagaatctttctaacgaagagtttgaagaattaggagaagttgatccggcatttacaaatgtggagtagtaagaaaaaggcagacaccagtatccagggtctgcctttttatatcagaaaagatacgtttttaaaagcagatggcaagtggaaagcagcctatattttatcagcattcctggtaattgctatgttatgcatgattttttgtttttcagcagcagatgccacgcattcctcgcatttaagtgaaggagtatgcattcggcttgttcgtgaagtcagttccgttttcccggaacagtttccaaaagagaggatgcttaaaatcgcagcaatcatagagttcccgattcggaaatgtgcacatttttcagaatatgcagtgttgagtattaccatcaatttatatttgtgggtttgctttcgcatggaacgattgctagaagcaaagaaatggaagatctttttaagagcagaagttttttgtgcattgtatgcctgcagtgatgaacttcatcagtattttgtgccgggaagaagttgccgtttttttgatgtctgtgtggacagtacaggtgcatttttcggagcattgttattctggggaatgtattcttgtttgagcaaacgaaaaagacaggaaatttttagagtggatggatgttgacgcttttttataaaacagctacaataaaaatacgtatgaaataatggataatagaatcgatgtatgtcgatttaaagataaaagaaaaagaaaagcggattttccggatttgaagggagcgtttgaaatgaagtgcagtcagttattagaacatatagagtatacatgtttacagggaagcacagatgtaaaggtcagtgcggtagtgaatgattcaagaaagatagaagaaggctgtcttttcttgtgtattaagggagcttcttttgatggacatacgtttgcggcagaggcagccaaaaagggagcagcagttttagttgtagaagacgcagtagaagtaccggaaagcgtaacagtaattaaagtagataacactcgttatgctatggcattgatttcagcagcatggtttggttatccggcgaatgaacttacaacaatcgctgttaccggaacgaagggaaagacgacaacaacctatatggtaaaggcgttattagaagaagccggacataaagttggtgtcatcggaacgattgaggttgttattggagagaaacatatccctgtcaataatacgacaccggaatcttatgatattcacagctatttcagacagatggcagaagaggactgtgatgtagttgttatggaagcatcttcacagggctttaagttagacagaactgccggaattttgtttgattacggcttatttacgaacctttctccagatcatatcggaccgaatgaacataaggattttgcggaatatctttcttgcaaggcaaagctgtttcaacagtgtaaatatggatatgcgaatcttgatgatgagcattttgcagagattacgaagaatgccacttgccagatcgagacatttggcttgaatgaaaaggcagatttagcggcatatgatgtagcacttacgagagacagagatttcttaggtgtggattttgatttaaagggaacatatgaaggcagaatttcctgtggggtaccgggaacatttaatgtgcataatgcattaggagcaatctgcattgccggacatatgggtgtaacagtagaacagatgaataaagcgcttcgtcatttcagtgtgaagggaagagtacagattgtacctacaggatatgattatacattgattatcgattatgcacataatgcagtagcgttagagagtattttgaatacattaagagcatatgatcctccaagactgatcagtttatttggatgtggcggaaaccgttccaaacttcgccgttatgagatgggagaagtatccggcaagcttgcagattttacgattatcacatcggataatccaagatttgaggagccacaggcaattatcgatgatattttaacaggaatgaaaaagacagatggggaatatatttctattattgaccgtcgggaagcgatttcctatgcgatgcatcacgcacagccgggcgatatcgtagttcttgccggaaaaggtcatgaaacatatcaggagattaaaggcaagaagtatcatatgagcgaagaagaaatcgttcaggatgttcttgacggtaaatattaaagcaagggaaatagtatgggagacagtaatataagatatgctgatataattatagacatttcccatgaggcactcgataaggtatttcagtacagagtgcctctttccttatgggaagaagtgcagccaggcagtcgggttttcgttccgtttggaagaggaaaccgggaaacggaaggatatgtcattgcaattcgccaagaggcagactatgaggaaagtaagattaaggaaattctccgggtaaatacagaggggatttctgtagagtctgaattgatccaggttgcggcttttttaaaagaaaagtatggctcgacaatgatacaggcacttaggacagtgttgccggtaaagacgaaaatgaaaccgaaagaagaagtttttatcacactttccatagaaaaagatacggcgcagcaattacttggcgaatgggaacgtaagcattttacagccagagcaagatttttatcaatactgatcaaaaaagaaagaatgcgaaaagaagaagcggtgaaggcgtgtaattttcctttgaaagagcttagaaagctttcagaacaggggattataaagttagagtcaaggattaagtatagaaacccatttccggaacttgtaacaagaaagcagggctggcctttaaatgatgagcaaagagcaatcgtagataattttatagaagaatacaggaagggagagcgaagaacctatctgctatacggtattacaggaagtggtaagacggaggtctatctttctttgattaatgaagttcttgcggcaggcagacaggttattgtgctgattccggaaatctcgcttacttatcagacggtacgacgtttttatgagcgctttggagaacgaattgctgtcattaattccagaatgtcaaagggagagaagtcagatgcctgtgagagaatccgggcaggtgaggcagatgttatcattggggcacgttcggctttgtttgctccagcagaacggctggggctgattgtgatagatgaggaacatgatggagcctacaaaagtgatacttccccaaagtatcatgcaagggaaactgctatttatcgggctaagctttgtggagccagtgttgttctgggttctgctactccttctgtagaggcatatgcacatgcattaaacggagaatatcacttatggaccttaaaaaagcgagccgggaatgccatcttaccgaagacacagattgttgatcttagagaagagtttaaaaagggcaaccgttcgatttttagcgaggaacttcataaaaagataacggaatgtctggaaagaaaagaacagattatgctgtttttaaatcgacggggttttgcaggttttgtttcctgccgagcctgtggtcaggtgatcaagtgtccgcattgtgatgttacactgacctatcatcggaatggaaagctacgttgtcattattgtgggcatgaagaagtgttcacaaaacagtgtccgatttgtaaaagtccacatgtggcggcatttggccttggcacagaaaaggtagaagcggcgcttcatcaggaattcccagctgccagagtacttcgaatggatatggatacgacaaaaagaaagcatgcccacgaagagatgcttgctgcttttgcagctgggaaagcagatattcttctgggaacccagatgatcgtaaaagggcatgattatgccaatgtcactttagtaggaatccttgcagcggatctgtctcttcacgagcaggattttcgaagcggtgagaaaacatttcagcttttatgccaggcagccgggagagccggaagaggagagaaggtaggcaatgttattatccagacatactctccggaacattatgcgattgttgctgcagccagacattcttatgaggatttttttaaggaagaatatacataccggaaattaatggcttatccgccatgtgcacatatgctggtcatcctgatacaatccggtgatgaatcgcagtcgattatcgcaatgctccgtattgaaaagataatagagcaaagtcagtcaggagaggtggatccgatacagattttaaatcctggacaggcgagtctttcaaaacttaaagatgtatatagacaggttctttacttaaaacataaagaagaagagagattattggatttaaagagacggttagagccagttttagagaagcatccgatgtttgcgggaatatccatacagtttgattttgacccgctctcacattactaattcactttacgacaggcgcttacgatgttataatcgagagtgcattaaaaatacgaggaggaaaagaaatggcaattcgtaaaattcgctttattggcgatccatgtttaaataaagtatgtaaaccggtacagaaaatcaccccttcaatcgagacactgattgaggatatgttcgatacaatgtatgaggcaagaggggttggtttagcagcaccacagataggaattttaagaagaatctgtgtcattgatgttatggatggtgatccgattattttaattaatccggagattattgaaacatccggagaacagacagatgaagaaggatgcttaagtatcccaggcaagtgtgccagtgtgacacgagcagattatgttaaggttaagtcatttgatatggatctgaatcctgtaattattgaaggagagggacttcgtgcaagagctcttttacatgagatggatcatcttgacggtatcctttatggagagagagctaatgagccgtatcacgatgtggaggaagaagaatgcgagtagtatttatgggaacaccggattttgcggttcctacattagaagctcttatagagaatcatgaagttgtcggtgtcgtgacacagccggataagagaaaaggccgcggtaaagcgatggcattttcaccggtaaaggagaaggcattagaacatgagattccggtttatcagccggtaaaggtaagagaagaagcatttgttcaggtccttcgtgaactagatccagaggtgattgttgttgctgcctttggacagattcttccggaaagcattttaaatatgccgaagtatggatgtattaatgtacatgcttctttacttccaaagtatcgtggtgcagcaccgattcagtggtccgttattgacggagaaaaggaaaccggtgttacgatcatgtatatggaaaagggcttagataccggagatatgatagaacacgttgttgtaccgattgatgcgaaagaaaccggagagtctcttcatgataagcttgcagtggcaggaggtccgctgttattagatgttcttgcaaagttagagaatggaacagctgtacggactccacagaatgatgcagacagctgctatgcaaaaatgcttacaaaggatttaggtaagattgactggaataaagatgcagtatctattgaacgtctgatcaggggactaaattcctggccaagtgcgtataccgcatttcatgataagacacttaagatctgggatgctgatgtggaagaaggaagcagtgatgcacagccgggaaccgttgtaaaagttacaccggatgccctttatgtgcagacaggaaagaatctgcttaaactgaacgaagtacagattcagggcaaaaagagaatgccggtaaaggcatttttacttggacataaagtagaaattggaactttacttgggcaagataatgaaaacaaccgttaacaggtcagagaaaaagaaaggaaaagcagatggagaagcggacagatatgagagcggaagctctcgatacgctgattgatattgaaagaaataaaaagctttctcatattgcaatcggagagacactgatgcgccaccagtttgaaaaaaagtctgacagggctttttataccagactttgtgagggagtaacagagagaaagatttatctggattatatccttgatacgtattcaaaaacgccaatgagaaagtgtaagccgctcatacgctctcttctgcgaatgggagcataccagatcctgtttatggatgtaagagatgcggctgcctgttcggaggcagtatctcttgcaaaaaaaagaggatttgctagactcagtggttttgtaaacggagttttacgaaccatcgtaagagaaaaagaccgtctgcctgttcctgacaaaaaagaatttgataagtatctgagcatcacatattctgtaccggaatggcttagtcgtctcatgatcgaccagtatggtgctcaaactgcggagatgatgtttgcttcttttttagaggcaagaccactgacgatccgtaccaatctttctgtgattacaccagaggcattagaagaggaactgaaaaaagaaggggtcagtgtggaaagaggaacctaccttccctatgcccttacgatttctcatttgaattatcttgggaagcttgcagctttccgtcagggaaagtttgcagtacaagatgagagttcacagcttgctgtagaagtcgcggatatcaacgaaggcgattttgttcttgatgtctgtgcggcaccaggtgggaagacattccatgcggcagaccggcttcatggaaccggaaaggttctttcgagagatttaacagaatataagacagatctgatcgaggagaataaagaccggatgtgttatgagaatgtagaagtacagcaatgggatgcacttgtagaagatgaaagtcttttagaaagtgtggatgttcttcttgcagatcttccctgtagtggactgggcattatgggaaggaagaatgatatcaaatatcagatgacacagcagcagctttccgagcttgcacagctgcaaagaaatatactttccgttatctggaagtatgtaaaaccaggcggagagatgatattctctacctgtacactgaaccggggagagaatatagagaatatccgctggatagaagagaatacaccaatgcgtctggtatcgatagaagactatctgccagaaacccttaaaggcagaacaggaagtcagggatatttacagctgataccgggtaaggatagctgtgatggcttcttcatttcaaaatttgaaagaccggaggcgagatagatggatttaaaatccatgacaatggaagaactgacagattgtatagtagaacttggcgagaagaagtttcgggcaaagcagatttatggatggctgcatcagaagctggtaagaagtccggaggagatgagcaatgttccggcaaagtgtctggagaagcttttaaaagagcatcctttttatggagtagaagaagtagaacattatgtatcaaagatagatggtacacagaagtttttattttctctgcatgatggaaatatggtagagagtgtattgatgaagtataaacatggaaactccgtttgtatttcttcacaggcaggctgccgtatgggttgccgtttctgtgcatctacgttacttggattgtcaagaaacttatatccatccgaaatgcttgatcagatctatgcgattcagaaagttactggggagagagtatcgcatcttgtagtaatgggaacaggagaaccatttgataattttgaatcattatgccgtatgattgaactgctctgttcaccggaaggattgaatatcagtcatagaaatattacagtatctacctgcggaatcgtaccaaagatttatgaatttgcagatagaaatccgcaggttaccctggcgatttctttacattcgccaaatgatacgatgcgaaaagaactgatgccgatcgcaaataaatattctatggatgaactgatgaaggctgcgaagtattatacgaagacaaccggccggagaattacatttgaatacagccttgtaaaaggagttaacgataaaaaggaacatgccgaagaacttatttcaagagtgaaaggcatgaactgccatgttaatcttattccggtaaatccaattaaagaaagagattttgagcaatctacacagaataatgtaacggcatttaaacatatactggaacgacagcatattcaggtgacggtccgcagggagatgggaagagatattcaggctgcgtgcggacagttaaggaaaagttataaagaaaggagtgggaatgaatgaaatctttcggcataacggacattggaagaaagcgaaaagtaaatcaggattatctgtttttttctgatgagccggttggctgtttccccaatctctacattgtagcagacggaatgggtggacataaggctggcgataaagcatcctcttatgcggtaaaccgttttgtggagctggcgaagaaagagaagaaagaacttcccttcctcgttatggaacgacttttaaatgaagtaaatgaagcagtatacgaactgtcctgtaaagaagaacagtatgcaggaatgggtacaacatttgtagcagcgacagtagtagataaaacagcatatattatgaatgtgggggatagccggctatattattttgatggcaagatccgtcaggtaacaatggaccattctctcgtggaagaactggttcgagctggtgagattgaccggtcagaaagccggaatcatccacagaaaaatattataacaaaggcagtaggtgtggcagaagatattcagccggatttcttcattgttgatatggaagaaggaagtttgcttttattatgttctgacggactgacaaatatggtagacgatgaaaaactagaagagattttatcagaggattgtacagaagaagaatatgcaggcaaatgcatagaagaagctttattttatggtggccttgataatattgcggttgtcatcgcccggaatagaagtgggaggtgaagacattgctgcaaaaagggactattttagctggaagatatgaaatactcgaacatatcggttccggaggtatggcagatgtatacaaagccagatgccataaattaaaccgttatgtagcaatcaaggttctgcgccgggagtattgtgataatgaaagctttgtgcgaaagtttacagtagaagcgcagtctacagccggattgattcatcctaatattgtaaatatttacgatgcaggaaatgaagaaggtatccattatatcgtgatggaactggcggaaggaatgacattaaaacgctatatcagacgatatgggcgcttaagtgccagagagaccgtagacttcgcaattcagatcgcaagtggattgcaggctgcacatgagcatcatattatacacagagacattaagccacaaaatattctggtgtcagacagtggaacaattaaagttacagactttggaattgccagagcagcaacaggagatgatacgatttcatcaagtgcgatgggatcggtacgttatctttcaccggaacaggcaagaggcggctatgccgatgaaagaagtgatatttattctcttggtatcactatttatgagatggctacgggaaaggttccttttgatggggaaaatacagttgcgatcgcattgatgcatttgcgggatgaaattactccgccgcgttgttatttcccggatattccatccagcctggaaaaaattattttaaaatgtactatgaagcagccggaacagcgctatcagagtgcagcagaacttattcttgatctgcagaaggtatttttgtctccggacggtaattatgtatatgtggatccgttagtagatgattcaccgacaattcagagaaatacagaagacatagagaaaattcgtaaatccctgacaggaacagagagaaaaagagacgtagaagaaaagaaatctcaagtggaagaagagggagaagaggaagaagattataaagatgatgcatccatgaatccaaagcttgaaaagctaattcttgtaattacgatagccttcggtgttttagttgcctgtatcgtcttttatcttgttgggaattctcttcatttattccggacatcttctaataaaggaacgacacaggctgcggttgagacaacaacagaagcgccaaaggaggcaacgactgaatcaaagccagaagagacaaaatatacaaagatgccaaatctgatcggacttacgaaaaatgcagccgaagatgagatgaaagcattgggattaaaagcagactttgcgtatgaagacggaagcagcagtgcagacagtgatcttatcgtaaaaaaacaacagtataataaagatgatgcggttgcaattgattctacagtaaagattacacttggtaagaaagattcggcagatgcgacaacaactgcagaaaaagtggaagtaccggctatggtgaattatacagagaaaaaggccgaaaaagaattaacgaaggctggactcaaagtaaagaaagcatatgcaacaagcgataccgtaaaggaaggctatgtgatcaaacagagtcccaaaggtggaaccattgttaataaaggatttgctgtaacgattacaatcagtaaaggtgtaggaaagacaaccgtaccgtcgctgatcggtgtttcacaaagtgttgcagaaagagagttgaatcaggttggattaaagcttggtacagtaagctatgactatagtggagaagttggcgtaggcgatgttatttctcaaggaattgagtcgggaacatcggtagataagggaacaaaagtatcggttgttctaagccttggagaacaggaaagttatcgttatgaaggaagcgtaaacattgaagaacagccatttgatgagggggcttccggaagcgtaaagcttgtgttaaagcaggattcctgggaaagtaccatttattcaaagagtagtgtaagcaatgatgattttccgttaaacattacatttgaaggagacagagaaggtggcggaactgtaattatgtatgtaaatggcaaacaatataacacatatagtgtaaatttaagtgcgatttcagattagaagcttatataatgcgaaatcaagcacaaaaagattccgagagtacatcatattttatggaggaaagaatgacaggaaagattatgaaaggaatcggaggattctattatgtatatgttgaacagcaagggctttatgaatgtcgtgcaagaggtattttccgcaataaaaagatgaaaccgaatgttggtgacgttgtagatattgatgttttatctgaagaagaaaaaacagggaaccttgtaaagattcataaaagaaagaatcagttgattcgtccgatggcatcaaatgtagatcaggcgcttgtcattttctctgttcatgaaccagaaccgaactttcatttgctgaatcgctttctgatcacaatggagcaacaagagataccggtaatcatctgttttaataagacagacctctctacagagcagcagcaggaacagttaagaaaagattatgaaaacagcggctgtatcgtcgtgtttcaggcagcagcaaaaggcgagggggttacccaggtagaagagcttctgcgaggaaagacaaccattatggcaggaccctccggagtcggaaagtcatctactttaaattgcatcagcaaggacagacagatggagacaggagaagtcagtgagaagatcaaaagaggaaagcatacgacaagacattcagaattaatttatattggagaagacacctacttgatggacacaccgggctttagttctcttttccttgaaaatattgaaaaagaagatttgaagtattattttcctgaatttacaccttatgaaaatacatgtaagtttaacggatgctgtcatattcatgaacctggatgtgaagtgaaaaaagcattagaagaaggaaaaatcagcaaaatgcgttatgatgattactgtatgttttatgaggaactggcacagcagaagaaatggtaatgaattagtaatgaattaatgaatgattcctatctatcaatatgaatttcaaaaaagaggaaaacagtgactctgtaagaacagaaagtcagaaaggaatatcgagggatgaagaaaaagaagagtattttaattgtaagtggtggaagcatagatgtggattttgccaaagaatatttaagagaaagacagtatgaccatattgttgcggcagactccggtcttgcacactgcaaagagattggaatagaaccaacagatatccttggagattttgatagccttagaaatttagaattgttagaatactacagacaaaaaggaataccgttacgtgaatttccaacacgaaaagattataccgatacacatcttgcagtgaagtatgcaatagacctaaaagcagaagaagtaaccattttaggagcaacaggaacaagatatgatcatacacttgccaatatcagcctgctggcattattacgtgatgaaggaatcgacgcacagattgttgatgcccataacgaaatagaaatccttcgtggtccggccgagaaaaaatataagaaaaaatataatcggaaaggcagcgaaacagagcaaaagaaagaatatttttctattattgcattttcaccagaggtaacaggcattgatgaagagggattttcttatcctttacatcaggcagccctttataacaaagaaagcatcggtgtcagcaacgaaattgtggagaaggaagctactttacgattacaaagtggatatcttatcgttatgagaacaacagattagaaaagatagtgtaaaaaggcgttgtttttagaaaaaattgtgctataataacccctgtgaaagttttgaaagtacatgatatttacaggaggaaaaacataatgaaaaaacaactaaaagcaatttctgcctgtctgttgtctgcattacttgcaacaacagctttacctttttccaaagtagaggcaaagtcaaaatgggttgagatcaatggagtcaattacgaaataaaccgaatgacaggtgaatgtgaagccagtctgaatgtaacacagggaaagagcgaggtaacaattccaaataaagtttcctatcagggagatacttataaagtaaccttctttagctgggatgactgggagcaggactggaaggaagagacaagtcgtacatataaaccagcagctggttcttatcaggccgtacttgaaaagatcactattgcaaaaggcgttcgtgtttctgaaccggcatgccactatcagaagcttaaaacaattatttttgaagacccggcaggagtttccggaacagaattttatgattgtccacagcttcagagcctctacattcctaaaaaagtaaaatactggccaacggtgagaaagtgtccaaaagtaaagattacagcatcttctgctaatccgtatttaaaagtaatcaataatgacatttactcaaagaatggaaaagttctttatagtgtagcaagcacaaaaacaaagtataaagtaaagaagtctgtaaaagaaatagaagatggtgctttttacaaaaatgacagcattaagagtatttatcttccggattctataaaagaaatcggagaagaagcgtttggagacatggagaacctccagtcaatccgctttagcagatcaatcagtgaattagactatgcaatgtttaataagtgtaaaaagttaaaaacagtcaagcttccaaaaagaattcagacgattcgcggaaactttggaggaaagaaaaactgctaccttaaaaaaatatatatcaatgcggtaaatttaaagaagagtaatttaaaaagtcttccgaaaaaatgcaaagtatatgtaaagagtaaaaatgtaaaaaatcaggtcaaaaaagctggatttaaaggaaaagtgataatccggtaaagaaaagagaaaagaaaaaaggaaatcttacttaggtatttgtccaagtaagatttccttttttaatgctgttttgacactgacatcattttatacattaaatttaaataatacaacgtctccgtcctgcatgacatattcttttccctcagaacgtacaagacccttttctcttgcagcagtcatgcttccgttttcaattaaatcctgataactgataacatcagctttgataaatccacgttcaaaatcagaatggatttttccggctgcctgtggagcttttgtgccacgagtgattgtccatgcctttgattcgatcggaccggcagtaagataagagataagaccaagcagagaatagcttgctttgatgagcttttcaagtccagactcttttaagccgagatcttcaaggaacattgctttttcatcatcgtcaagttctgcgatctcctgctcaatctgagcacatacaacaaatacttctgcttcacagcccttcgcatattctctgactttttgtacaaaaggattttctgcaccatcatctgccaggtcatcttcagaaacgttagccgcaaagataacaggtttatctgtaagaagattacattcgcttaataatgcctgctcgtcctcatcttcagtaacaaatgttttagcaagctgtccatcttcaagatgtgcttttactttctttaaaaattctacttctgcagcaatcttcttatcattatgagctgctcgtgcggacttggaaatacggcggtctaatacttcgatatcagagaaaatcaactcaaagttaattgtttcgatatcacgaagaggatcgacacttccatcaacatgaataacattactgtcttcaaaacaacgtaccacatgaacgatcgcatctacttcacgaatatttgcaaggaactggtttccaagaccctctcctttagaagcaccttttacaagtccggcgatatcaacaaattcaattgtagccggaacaatctttgcggaatcatacatatcagacagtactttaagacgctgatccggaacggcaacaataccaatattcggatctatagtacagaatggataattggcagactctgctccagcctttgtcagagagttaaataatgtactctttccaacgttaggaaggccaacgatacctaatttcattttatctttacctgtccgaaaaccctttatttatgcgggttttcgcctttctctatatttttattacaccctttttacacccttttttcaactgtgggtgtagctgcttcaaattgctgaacagcttttgcaaaggactcgtccgtaacatggacatacctgtccattgttgttttaatacttgcgtgtcctaatagttgctgtaaaactttaggttgtacgccgcgttcaatcgcgcgtgtagcataagtgtgtcgtaaggcgtgcatacaaaaacgcttaataccagcttcatcacacaatttatataaatgtgtatcgtaggaactgtttttagcaggttctcctgttcgccagttgataaataccaaatcccgcatgacaagacatttcttttctcccgttctgctgtctgtgtactccaaaatctgtgaaagcatttcagactctttccgggtatctttttcatcataacaactttttaggattgtatatgcgcgttctgtaagcggaatagtacgataacttttttttgttttaggcggaccggcacgccaatatctccggctgtgtcgatactctaaactcttatttacagttaaagtacgttttttccaatcaatagcgtcccatgtcagaccaatcaattcagccgttctcaaacccgtttctaataacaaagcatactgtctataattatgagaacgctctgcggcttcaagaaacttttcctgttcctcaacggttaagtatttaatatcatctactgcccggactggtttcgtatatcgaacaccattcatagggtgctttgcaataatatcattcataactgctgatttgaacatagttcccattgaaatataggtctgccggattgttgagcctgcatattctgtttccattcgatttaagacagctttacagtgcataggttttacatcagctatacacatagttcctatcaatggttgaatatttctttcgtaacgctcacgataatttctaatcgtgtttggcgcaaggtcacaaatgatattatcaatccaataattgaaccatttgtctactgtcatatcaggcgcagtaacgattagattatgtgtatcttcatactttgcgtcagcaagccatttttttgcttctggcagcgttttgaaatatccattttgacgcgtaccatttttagcataaaatcttgcgaaatacaaaccgtcctttctttgacaaataccttttccacactctttgccttttaaattttttcccatgacggactcctttcacgtaaaaaaagagtccaacgcaaatataaagtatatcacaaggactccgttttttcaagcttaacagacaaatatttcagctattaaaggctatataatcaattctcggcgaatgtattcctcaaattctttacgcttcactaactttcgtgttccaacatataaaacaaaagggcagtttggctgttttaacatagaatcaatcttattgatacctatgttgctatattcagcggcttcccttattgttaatgttattttcaaatggataggtactcttacttctgtttccttatataaaggcagttctttttcttcactgctatttgatttattcattagaatttccccctatcttttttcaatttaacaaaaaataggctcgtcagacggtcttagcaaacctcacaagaatttcacttccgcatggttctcatgcagctctacccgttgcctgcgacgcttctaacgctcggactacggcggtaaaggagtatcattataccgatatatggattgtggcggcagagttgctaagtctgctttggaacactgataattctcgctcgttttgtccctcctttcggtcatggcgtatcagcccaacggctccccatatatcgaatgtatccgatttgccttatgctgcgtcgccgttctattgcgccgctttctttgtcaaagagcagggggctgttctgcgatatggaacggaaaagggggaagcgttccaataccgcgttgctttattcagccctaaatgtgaggattgccctcattagttttgcttgcagcctttcacgtatttcttcgtctactccaaaataaacatttcctcgctcatcatagagcttccgcatggaaagacttgctatgtagccgctgaaatgctgcaatacaatcttcattgcatccgggtcgcctttgctcgccgccaaaataacgggatagggaacaagggcattttccgggtagtcgttttgattaccattcaatccattcatcagcgttttcctccaaatatttttttagctgctcaaaggagcttgtccggcgatactgtaccgtacttcttgagatattgagctgctttgcgatttctatatcagtcaatccctcaaagtaatacagcagtacaattttgcgccgttcttcgggtaaagcccggatagcttcaagtagcagttttggggttatttcttttcctgccatttgataagacggctctgcttcttcatcttgaaaatacttatcgacggtataaagctgccgttcctcatacaaggcaaggtcggaaaaagtaacttcccgaactctgcgccgacgaatttcttcatgggcgttgcacgcttcattgtgcagcactgatttacagaacttttgaaacgtacattgtttttcaaattccctgcgattaggtgtcatggtgttcacctcctttctgccgaaaggcggtagtacctccccttttcgcgggataatacaggcgactttttgctttgccaaaaagagggcaaagtttttgaaaaatcttctgtaaaatgcgaaatgcgcctgcctgcaaaatgcagacagacgcataggaaataacagcagtatttaattgatttgatagttcatctacatagccggaataccccgtcggtggataatggctttttttgatagtaacccattagggtatagaaaaaaggacatggcgatacctccttgataccgtcgtgtccccaaatagcaggattttaatatgtcctctgttttagattttcaaaagaaaacgacggttttgattgttatttcaaaaccgccgttagaatggcatgagaactttctacttcataagcggttttttttatttcatgcttatgaagtagagagtttttaccttatcgtaaattcacaagataaattatatgtatcgtaatcccaatctctttcactttcaaagaacgcaaattgtttaatcaaacgatagtgtccagcaggcaattctccataaaaacttttaacatcaatttctaatgttaatcgttcgttaggcttaataaaacaatccttttcattgctctttgaggggtcatcaagctgttcaagttgataccaagtgccggattgttcagcttctatttcaaaataatttggtgaatatcggtattctttatcagaagtattttctattagaaatgaaaggtgcttcaaatctaaatccttttctgtactcattgaaatcttcaaatcgtccaaagtgtcaagtgcttcttcacttccataaggagaaacctcatattcttcagaataatcttgtactacatgattatcactgtcctttgtttgactacacccaacaatacacaccgatagcaataaagttagaaacatacatattatttttttcatttgtcattatctcctttcttttaaatttataatagcaataaaatatctattttcaatcaactttcattgcaatttattttcactgtaacacatgctccccctgctttattattagcaatttggatatttccgccatgtctttcacttaaaatcttactaatattcagccctaaccccaaatgttcagtagatatatcttttgatgatttataaaatggtaatgttgctttttcaatctcaatatttttaaacccgcaaccatcgtctgaaacagatataaccaaattattattctctattactacgctaatagcaatatcactttttgcatatctaatactattagagagtaaattttcataaatctgcatgactgtatctaaattgataaacaaggttatattatcaccgcttgcagtaattgaaaaatgtttgtcataacaaagtgtttctgctgtgttattaaaattatcaataagtgaatgaaatgtaatctgttgtcgtggaatatcaatatcctctaacctgtataagttcgtcatagcatttacatatttttcaagacgtgaaatattttttgacattactgatatttcgtctaatatttcttcttgtgatactaagcctttgggaataaaggaaagcaacatagtagcatgaccctttagtaaagtcaaaggagtgcgtaagtcatgtgaaaaagcagcattcaaacggcgctgttcagcaaattgtctaaacatagtttcattattcttcgacaaacaatctttcattttttcaaaggcgtgacagagtttccccatttcatcatttaatggatatgataatgtaaaatctaagtcatttgcttcaattttatgatacgcattagttaatagcttaatgggttttgataatttttttttataaaaaaatgttacacaacatatcatactaatagataatacgataggaataattgcaatatttaatgaacctaaagcactgtcaataagcctatcccggcttgtaaaattaggtaaaacttcgatatatgaaacatggttcggatagacatattcgtgtactgggcgttctttttgataatcaacattgaacttgcatatctcgtttcctttcgtgtcaaatattgtatattttgtttggtcattactataagtggcggtaaatgagccattttccggtatatcataccttgttgacatattttcatacttatagtttaaatttattctgtatctgtcaaccattgaaattaaaaatatacaaataattattccaatcaacaacgaaaacaaagcataaagaacaaaggacattctaatactcatgctatttaaccgattgaacaatctgcttctctttaatttttccatttatatccgcacccccaaacagtttcaatgtaaggtctatcgcctaaagataaaaattttgccctaatacgtctgatatgttctgtaacaactgtattatcaccaatgccgtctaatccccaaactttttcataaatagtttcccggtcaaaaacaattcctttgttttgcgaaaggaaagatattatatcaaattcttttttggtaaaagccatatccttattatgataaaacacaatacgtgaggaataatctataaccatatcttcatcaaattgcacctttgaagatgtattgtgtcttttttctctgcgaagatgtgctgcaatgcgagcttctaattcatcaacagaaaatggttttattacatagtcgtctgcgccaatagaaaatccttttattttatcactatcttcaatgcgtgctgttaaaaaaattatagggcatgaaacataatcccgtattctttcacaaacagtaaatccatcaatatctggcatattaacgtctaacaaaataatgtcaggttttttttctacttcttttaatgcagcatttcctgctgttgcagtatataccgtatatccaagtttgctgaaatagcaatacagcattgatacaatttctttttcatcgtctacaattaaaatactctgcgccataaatatacctcccttgtaaatatctgatttaagattatcaaacaaaaatctatttctaatcaatttctttaattttcgatgtcattagatattatatatggcagtatgagtgatagcaaccttactctgcacgttttatgctctattactatcaatactatgatatgtgtactcatatcttgaaagaaaggtgaacggtaaaatgtaactgggtgaaatgattatgaagcagagtaaagagaaatttgattttaaggctttcggacaagccattaaagcagcaagaaaagcaaagggaatatcacgcaatcagttagccgacacgctgaatattgcgccccgatatatcgcgtccattgagaacagcgggcagcacccaagtttacagattttgtatgagcttgtaaccctgcttgacgtatcagtagaccagttctttttcccggaacgggaacaggagaagtccacacgccgccgtcagctcgataccatgcttgacactatgagcgaaacggacttaaaaatcatgtctgctactgcaaaaggcatagaggaagccaacaacgacaggacgggggaataaagttccctcgtttttgtctgcataaagtgattgaagcgtcgcaggattgcggcgtttttcttttgcacttttttggcatactggaagtttcgttgtagtggtaagtgaggaaaaaactttcttagcaagcataggaaaagagtacccttttccgtattttcgccctcccgtcctgcggtgtgtcggttgaaaattgcttgttgggaagtgtcccaaaccctcggaatggaaaggatcgattgcatgaacggacgcaaaagaaaaatacaaatcaaattctatgtaacagaggaagaaagggcattgattgaacagaaaatgaagctcgtccccacccggaacatggcggcgtatcttcgcaagattgccattgacgggtatatcattcagacagaccatagcgacataaaagccatgacagcagagatacagaaaatcggggtcaacatcaatcagattgcaaagcgtgtcaatgcgacaggcagcgtctaccaagaggacatagaggaaataaagggggtgcttgcggagatatggcggttacaaagattaagcctattaaaagcacgttgagcaaagcccttgactatatccaaaacccggataaaacagacgggaaaatgcttgtgtcctcctttgggtgcagctatgaaacggcagacattgagttcggatttacgcttgcacaagccatagagaaagggaacaatctcgcccaccatttgatacagtcctttgagccgggagaagtagactatgagaaagcccacgctatcggaaagcagcttgccgacgcggtaacaaagggacagcatgaatacgtcttaactacccacatagacaaagggcatattcacaaccatatcattttttgtgcggtcaattttgttgactaccataagtacaattccaataagcgcagctactacggcatacggaacatgagcgataagctgtgtcgggaaaacgggctgtctgttgtcgttccgggcaaaggcagcaagggaaaaagctatgcagaatatcaagcggaaaaggtcggtacaagttggaaaggcaagctgaaaattgccgttgatacacttatcccccaagtggcaagttttgaagaattgttgcaacggttacaggcggcaggctatgaaataaagccgggaaaatatatctcctgtcgcgctcccggacaggaacggtttacccgcttaaaaactctcggtgcagactatacagcggaagcaatcaaagaacggattgcaggcaagcgcacaaaggcggcgaaagctcccaaagagcagcgcggcgtatcgttgcttattgacattgaaaacagtatcaaggcacaagagagccggggctatgaacagtgggcgaaaatccataatctgaaactggctgcaaagactatgaatttcttgacagaacataagattgagcagtacgcagatttaatcagccggattgaggaaataaatgcggaaaatgtaaagacagcagacgcattaaagagcgtggaaaagcgtcttacagatatggcggtgctgatgaagcacgttaccacctaccaaaagacaaaacctgtttatgaagcataccgcagggcaaaggataaggacgcataccgggcaaagcaggaaagcagtctgatactccatgaagcggcggcaaaggcattgaaagcggcgggcgttaccaagctccccaatcttgccgccatgcaggaagaatacgggaaactccaagcgcagaaagaagccctttacgctgattatggaaagctgaaaaaacaggtcaaggaatacgacgttatcaaacagaacatagacagcattttgcggcaggggaaagagccggaacgtggaaaggaaacagagcgcggataaagtctatatatggaatatctcaaagaattatggtaaaatatatttattgaaaaatactgtaaaggtaggataaattatgtcatttataaaacgccataagatactttttatattatttgcagtaagcattttcttaatgattaaaaattcatctattccatattcttttgctcctcctgcaattatatcatttatttttgacgctccgaaaagcgactttttttcgggtatggctcaaatgattgatatattcacttctgcatatgtaacaagtttagttttctattatatggtggattatcttcctgctataaaacaagaaaagaaagctaaagaaattattgcacctaaattagtaagtttatacctgtatattagtgaactccttgcaatgattaaatatgcagcagagcaagaaaaactattgcaaacgggaaaacccgaagatatggataaacttcatttcaaaaataaagttattctatgtaagcaaaagtctttcaaaaatgaagttgaaaacggaacgacaccatactcttttgatttgttgaaagattgtgacaactttagggcgctaattctaaatatttgcaacgaaatatccggcacgccaagcttttcctattgtgacacacaagtaatacatattatttcagaaatccaactgtctgaattgttgcgaattttaccgaaaccgaatgattttttattgcaatttgattttgctgatgtttcatatttaggattaggtgaggggtatcaacagcttctttcaatttacaaagaactagcggtttttgttgatacaagacatggctacgaaatgatagacatatcaaaagaggaaatacaagagtggcaagaagaacaagtagagtcattgaaagaacaccccgaaatagctcaaatacttattgctaatcaaagacaaaacaaataaaaagacgggcaacagcagccatgtaatcatagccgccgcgcccgttttttgtgggtacagatgatttgatatgttacgcagtagaaccccgatttcaagggaaaaggtattctgtatcgcctatgccagtttcacgccgtttatgccctgtaaatcaaggctctttttgcccttattgcgtaaccgccgcacgccgtttcctcatgcgctcggccgcctgtctgcgggtaatccgctttcggcagtccgggcagtatttgacgctgtttgattttgatacaaagaacgtgccgcactcggtacaacgctttttatcctcggtcttgaaaagctctgcatacagcagtttatcaagaggaagtacggtagtctgaaaccattcgcatagaagcgaataggaaataagctgcgggcagacacattcctccccgtcgtccagtaaaatacagtgtccgttatcgcagttgcagcactccttttttacaaggctgttgacttttcggctttggggcggcgtaagccgcttacccccggtcatacctcatcagcggcgaaaatagcaagc

SEQ ID NO: 435 - DNA, 29770 bp, Eubacterium hallii
atgtatgcacgcttgatacatacccattataatcctcttcaaaatcattctttgctacatccacacttctccaaagacataatgacatgaccgtatatgcaatcagtaaccaggattcgtacgtacggactataccatactgcgcctgtgtcagtaacctggaatagatcggggttacagcaaaggtcagccctcttgcaaaaagctgtgccaggataaagaaaaatcctgaggtaaaggctcttttattcaaagaggcatctttattctttcctgccatgatctgccctccatctaataattatcctgttggtttctctgtcagatacctgttgtaatctattattgctattaaatacttccattaatcctgtaccttacatacgatcatacgaagcttaccattcttatccggtggaatagaatccatccactcatacacaatctcaaacggatgcttgaacttcgcatttaactttgcggtcatatctttctcgacttcttccttactcagcttagactccgccttattatgtacgcactgaatatgaatcttatggtacgtttcctgaataaaacgcatctgaagtatatcttcacagtgggcaatgattggagcaatttcaaagaaagtagttacttctcctgtctcatagcggaaaaagtcattcatccttccctgtacacttgtgatatagcggacaccatcccgaacctcgcaggttcccctgtctccaatcgcataattaataagtggtaaatccgttttataaagtggtgtaactacaatattaccctctttcgccggacgattcttttcatcgtaaatatttaccacaaaggaatcattatggaccgtatattctttattatcaaaaagccgtaccatcgccgcaccggtctctgcagttccataagaatcaataattcccggtccaagaatctccgcaaaaagctttcttgctgtatcgtctatcttctccccagtaggacagtaaaacttcggcttctcaagctccacatgattctgtttacagtacagacaaatacgcataaattcactcttattcatatataaaaagtctggcttatatgcattgatctgcttcacaatctccggttccggcgcatactgatcgacaaagccacgacgaagaattccaaaatgctgtaaaaatgtatcactgcctccggaaatactatgggcactcttacgactcattgtcttgcctttaaatggattataaccggcacacatcataactcggaaccagttcgccatattatatgccttctctttcggagaaacaagtaacatcagaggaattcctgaagaaccactcgttgtatcatgaaaccagcaatcatacttcggatccttcgcctcctcattcatccatgcacgaagctcatccttcgtaagtaacggaagcttagacagatcatcccctgtacgaatatcctccggcttcactccagcctcatcaaatctcttcctgtaaaatggaatctcatacgctcgttttacaagctttcttacacgcttatcctgtgtgcgcataaccccgctaaaatcctctggaatctttgtcttcatcttaaacagatcaaaaaaaagcagcacatttacaagctttctctctaacttctcaaacatgtcttctcctcttttcttttcggatatctctcttaaagtttttattcccataagacaaatatcaatcacttcattactatagtactatatcagaaatcgactcactgtaaacagtttcatctgttctgtaaatatcttaaatattgtatataagaaaaattattttgtcaactgatagcatcttcctcaaatcaagaaaatccccttattaatagaaaaaaggcatccctcgtggcaggatgcctcccaaaattactgttatttaatagtaattttaactacttttttaccctgtttgtggttcttagtagcttttgctttaattacaatcttataagtacctttcttgatacccttcttgattgtaaccttaccatttttacttactttaatatactttttagcagatttctttcctgtaactttataagttacttttttgctaatagcttttgttttaagattaaatgtcttacctttcttcttaatagtagaagacttgtaagttttagcttttgtagaagtcttaatcttctgctctgctttctcaatcttataagtcactgttgttgttccagagtagttaccgatgcctttaattgtaattttgtaagtaccgacattcttcttaccactctttttcttctttacgattacacaatcttttccaacaacaagcttctgaccatttacagtaattgttgtaggtaactgtgttttcttattgtacgttactgtagcagtagcttttttcttgttaatgttagtatctcttaccgatggggcagccgcatgaactgctgccggagccatcagcattactgccagaagtaccgctacaattctctttactgttttcacaatttatgcctccttttgacaaaaatctttcggccacgacgaaaaattgtgtccaatttaaatataatcaacatcctctaataatatgatacacacatcatactatttgtagaaatgtaattattactctttagtacctgttttcttttctgtcgtattgcctccatagtaagcaccataataatcaccatatttcttaccataacgattgtaatacttcttataagctccgcttctgatttccgcacgatttaataccgttccaagaaccgggcagccaaccctgtcaagctgctgcagggactgtcttaccagcgctttggaagtctctccacaacgtacaactaagactgccccatcactcatgctggcaataagcgctccatcagaaatattatccaacggcggcgtatcaataataacatatcgataatcttctgctaatctgtcaagaagctctcctaatctcggatcttccaataaagcagatggattctccagcaatgtagtaaccggaacaatatgtccatttggaatatttgtctcgtatacaacatcttcatactctgccagaccggaaaggaaatggttcagcccttcctcaattccttctacttcatacttcttctgtaattcagatttacgtaaatccacatctaccagaacagtaggaaaacctgcctctgaaagaagcttccataaacgtacagaaactgtactctttccttcattaggaacactgcttgtaataacaatcttctttgtattcttaccacagaacttaatatttactcttaaacgattcaaagcctcttctgcagcgtaaggcatatcctttatttttaaattcaacttcttcattacttactaaatcccttctccagctttccctttttctgctgtttttccgatgcaagctcctcaacatccggaattactgccaaaggtacaatatcaaagtacttctccatatcatctgctgtatggatcgtatcatccataagatacttcactacaagatacatacagtagaggaacgctcctgctaatgcaccgatcattgtatacttcgtgtagcttgggccatccttatgatctgctaatttagctttctgtgcaacgtttggtgcgttcgtactcatcgtcttaggaagatagtcaacagaaacatccataagtgtattcgcaatatctcttgcactctttggatcagtacttactacattaatatttaaaatacgggtatctgtcggattctctaatgtgatcatctttgcaagtgtatcagaatccatatccagattcagtttattgattacctgctctaacaccggataacttaacatcaactgctcataatcagctgtcagcgatgtaccgatattcaaagcatctaaatcaactactgaattcttagatgcagatacaacatacatcttcgctgttgacttataagtcggacgaacaagaaaataggaatatgcattcattatcactgctccgatcaaaaagcacagcacaatataatgtatcttgtcaagcaatgcccatgccagatcaatcagatcaatttctgcttcctgctctgttctatccgcaaaactactgcgaacatcctctttacctccggaaatcacttcaaattccggggtactctcctcattcctgttattaataagactcatcttctttcctcattcctgttatttttctactttattaaaaaacagctccatcgctacttcgccacggcttgtttcatccatagtaaattcattaaaaccatcatcttctgcaatagcgttcgttcctttgatagaaagctcgcctttatcttcgctgttcataatcatattggcgacatttcccatctctccaacactcatatccgttaccatataatccgagagatcattataaaattcattaacaaatccgctatccgcctgtaactttgctttatacaaagggaacagcgcatcaacatatgccttctgtctgcgcatacggcactcatttgtaccatctcctacattcattctgtcatgaacataatgcatcgcctgatcatctgtcaatgttatattctgccccatgacaagagatgggtctgactgggaaaaatcatcctcaatcgtaacaggcacgcctcctgccaaatgattcaatattttaatcgaatccatattcaatgaaatatatccttcaatccgaataccgtacagcatattcgatactgcatctaccgtattctcacaactcagttccattccatcaccctttgcatgtgcaagcgcaatctgtgtcttcgttgtagcaagataagaaccatcctcatctaatgactttacatcggttatcgtatctctgttaattggaagcttatgatatgtattcttcttcgtatcaattacaagaagctcaagaacatcactctgtccggttccatccgattctgtcttacgtgtcttcacacctctggcatcttctccaataaaaagatacgtctgcacatcccagttcggtttacattctacaccattgatcttaacaacatctgactctgtcgctgcatccttctgccctgtattcatcttctgattatcaacaatatgcccgatcacaaccgttgccgtacagacaataacaaagaccgccaccactgtagcaagcttctttgcaagcttctccttttcacttctgctatagtacttcttcgccatctaagacacctcagttaaaaaatcccctggagcaaagcacttcccgctcccggattcatcttctcacatacaagaagaactgcaagaatcacaaacaagatcacactgataataattgaaactttctttgacatctacttatcctccaaacccagcagcactgctgcttctttatccattttatcaataaaggtacttcccatcatcttctcaagcgcctcgcgcccattcttaagattcggaactctgtgattaagaccatgacagtcacttccaagaaaaatctgttcctttttcctgatcatctttaaaatctgtcttctttcaccccatcgctcaaagctgccggcattaatctgtacataaacaggaagttccatcaattcgtaaactccctttttattccccggaatcatcagaaaacgttccagatgagcgagtataacatgcagcttcctgcgctctaaaatatatctcacttcttcaatctcagacttgttccactttgtaaaaggcatctccagcaaaagaagatccgtcccctcataagtaagttcttctaaacgctccgccctgcttatgcctgtaaaaaaagcgacctccgctcccattatcagccttggaatcctctcttcttttgtcagttcctggttcattcgttccttcaaacgttcctctgaacaccttcttctgttcaaaaaagaagaaattctgtcttctgtggcataaaaatgagacgttgccgccattacatctattccctgtgaagctgagatctgtagcatccccaaagattcctccgaactatggctcccgtcatctatacggggaagcacatgtgaatggaaatctattactgacattctcttaccctctctattctatttatctaaataatctacctgaataattaatcaaaattataaattaccactttctttaacattttataccaaagcgctataaattgcaatgtattatcttctaataatatttctcaaaaacaaaatctttcccaacaaaatatacaaatttcatttgcaaaggttgaaacaaacaccatttaaatgaaaaaagaaacgaaaaccagaaatttgagatagaagaaaaagtgaagatagtcgcttcgtagaaaatgcctgcccggcatttttactcgctccgacatcacttttcttctatctcaaatttctggttttctgctttttggctccagaaggggggggatactttcttacttgattgtataaaaattacatttatcttttcctgtcttatgtagaatttttctctggttaactcccataatcttctggacaatcccccattctcactaactgtagatttagtatagtcagaaaaaagaaaaaataccatatcccagatgcggcttcggagcgtgtttaagatgcggacgagcattttaaacacagcgactacagagcagatgggatatggtattttttcttttttcgtctatacgaaatattatcttccgattaaagtattatatagttcttcataacgcttcttggatacgccccaagaaagatccttttccatcgctcttgccaccatatggttccaaagctctggctgttcaaagtaaatatacttgctgtaatttactgtattgatgagttcttctccgttgtagttactgaaggagaatccgtctccggtatcctcaaattcgttcagaggaataacggtatcttttaatccacctgtttcgcgaacgattggaatcgttccataatggaaagcgataatctgtgttaaaccacatggttcaaataaggatggcattaagaaggagtctgctgcagcatataacttatgtgccagatcgtcggaatagagaatattcgcagacaccttatctgaattgcaccatgcataataacggaacatttcctcgtatgccggatctcctgttccgattactacaacctgtgtattgtcatcgataatcttatccattgcgtagcgtaccagatcaagacccttctgatctgtcagacgggagatcaatccgatcatatatttatttggattcacttcaaggccaagttgcttctggagttctgccttgttggcagcctttccttctttatggtctctttctgtataattccgataaatctttgcatcgttagctgggtcatacaatgcataatcaacgccatttacaattccaaaaagactctgattacgtgcgcttaacagtccgtctaatccttctccatagtatgcggtctggatttcctgtgcgtaagtattacttacggttgtaatgaaatcagagtaaacgattccgccttttaacatattggcatctttcttaaactctaacttatccggtgtgaacagttcatctggcagtccacttaaacctctcatagtcttaatatcccacactccctggaaacgaagattatgaatcgtcataattgtcttaattccccagaaaaatggattagctgcaaactctgtttttaagtaaaccggaatcagccctgtctgccagtcatgacagtggatgaggtccggacggaaatcgataacaggaagtatcgaaaggactgctttacagaagaaagtgaatctttcaacgtctgttcttgtatctgagtatggctcccacgctccaaagtaatctaaattatcaataaaataataggtaatgccattataaacatatttcataatacctacatgaacattaggaatatatggacctactcccatatagaaatgcgtaacatattcaaaattattacgatactcttctggaattccccggtagtttggcattacaacacgcacatcccactcgtttttgtcaaattcttttggtaacgctcctactacgtcagcgagtccgcctgttttcataaaaggcacgcattcagaagctgcaaacagaatctttttcatagtaatcctccctgtattatcttatattgtaatacttatattttacaatatatttcatcataataccatgtttatttctggcttttcagaaaagatgttaagaattttaagaactttttcatttcttcatctgttccaatggtaattctcagataattattaatacgaggtttatcaaaatatcttacgtaaatattgtttgctctggcggcttcaaagatttcttttgccggtacatccggatgggaagcaaacaggaagtttgcctgagaatccgggaaagtaaatccaagcttcttcatttcagctttaaaccactctctcgtatgaacaatcttttctacagtttctttaaagtaagcatcgtcctcaacggatgctgttcctaaaagaatcgatgggcgattcattgtgtaggagttaaaggaatacttcacatcatttaaagctttaattaattctgcagaacccatagcatatccgatacgcattcctgccatagaacgtgatttggaaaatgtctgcacaactaaaaggttctcatatttagaaagaagctgctgcgcactgtgtcctccaaagtctacatatgcctcatctacaataacaatgacatcttgattatgagcgataatatcctcaatctcatcaagtggcatcaaaactcctgtaggtgcgttcgggtttgggaatacgactccaccgtttttccagtagtaatcgtcttttttaatcataaagttttcatctaatggcttcttatcatatgggattttgaataaatcagcccacacatcataaaaagaatacgtgatatcagggaaaaatatcggcttttcgctattaaaaaatgtaagaaaagccatagccagtacatcatcggagccgactccgacaaaaacctgattgctgtctaatcccttgtattttgcgattgcttccactaacattccggctgtcggatccggataaagacgcagttcttctgttttagcacagattttcgcacactgttcttttacctttggtgaaggtggataaggattctcattcgtgtttaactttattacatttgcttcttttggctgttcgccaggtacgtacggaacaacctgtctgatatttttcttccactcctgcataatttttaacgctccatttcctgcaatttacttaatttggctgcctggtctgctgctgttaagctatcgatgatctcatcgagatctccatttaaaatatcatcaagacgatggagagttaatttaattctgtgatctgtcacacgtccctgtgggaagttgtaagtacgaatcttctctgctctgtcacctgttccaatctggctcttacgaagttcggcctctgcatcatgtgctttggactgctctaaatcatacaaacgtgcgcgcagtactttgattgctttatctttatttttaagctgtgacttttcatcctgacaggaaataacgatacctgttgggatatgtgttaatcgaacagcggaatcggttgtatttacgcactgaccaccgtttccggaagcacggaatacatcaaatcgacaatcattcatatcaagctgtacatcaacttcttctgcttccggcataattgccacagtgattgtagatgtgtgaatacgtccgccggactctgtcgcagggatacgctgtacacgatgaacaccactttcgtatttcaatcttgagtatgcgccctgaccattgatcataaaggaaacttccttgaatccaccaataccattctcattcacatcgatgaactctgttttccaacgttttgattctgcatagtttttatacatacgataaatttcagcagcaaataatgcggcctcatccccgccggcacctgcacggatctcaacgataacgttcttatcatcgttagggtcttttggaagaaggagaacctttaattcctcttcatactgttctacattcttctttgcttcagataactcctctttcagaagctcacgcatttcctcatcgtgttcttcttcaagcatctctacactgtcttcaattgtctgtttggcttctttatactctttgtatttctctacgatcggagctagctcattctgttctttcatcagattgcggaaacggttctgatcacttactacatccggctcactcagttcctgcataacctcatccagacgttttacaagatcttctaatttatcaaacatctttcttcctcctgctattctatattttataaccatctggctttactctattgccaaatgatcatacatttatgatgtgttttgtaatcgaaattacagactatcttctactatatatgcctgtcgcgattcggtcaagtcctgcaagatctttatgcacttttacttcagaaaatcctctgtctgtcataaggcgaatcatatcttcaccctgttctgctccgatttcaaaatagattcttccatttgaatttagataatccggagcctgttctataattttccgataaaaagcaagaccatcttcctctccatcaagagcaagtcgtggctcatgatcttttacctcaggcatcagtccctgaattacctgcgagggaatatacggtggatttgataaaatgtaatcgaatcttccttctatattttcaaaaagatttcctcttattaaagtgacatttgcattcaagttttctgcattcttcttagcaaccgctaacgctccctcagaaatatctgcaagggttacttttgtattttgacaaagcttttttacagaaataccgatacagccgctacctgtacataaatctagcactttgactttctgttcatttttctgatctgctgcattattaaactcacatcggttctgtgtctttacattccgaatatcttcgacagccagctcaaccagacactctgtatcctgtcttggaattaaaactctctcatcaacactgaaatcaaatcccataaattcacattcacccatgagatattgtaaaggaactctctgttctctttttaaaagaacttcttccagatcctccagaagctcctgctttacttccccgtttggattcatataaaattctgcccggtcaatgtgaagcttccactcaagcaaaacccagctttcatattcaaaatcttcaattcctgctttttgcaggcgttctcgtatatttgttaaaatgtcccgaattgtcatgttcaatcctccagctctccattatgcattgcccgaagatactctttccaatcaaatacaccttctaccgctttgattgccacttccatcatctcttcatctggctctctcgttgtaaagtactgaagatacaagccaggcttactaagcgtattcacaagcttcgaatcacttcttcctgccagacggataaattcataggaaatccccgctacaatcggaacaagtaagatacgtaaaacaaacttccataataagctatctacacgaataaacataaacactatgatactgacaatcataacaataagcagaaaactggttccacaacgcttatgaagcctcgaatactttttaatattttccggtgtcagatcttcaccatgttctaaacagttgatcgtcttatgttctgcaccatgatacataaatacccgctttatatcctccatcttagatataagccatatatatattagaaataacgccacacgtatgattccttcaatcagggtacgtatactgtaagatggcagaaatcctttcatcagattcgtaaggaaaaatggaagtaccataaaaatcccaagcgccaatataacagaaatgaccattgtgattcccattagaacgctttctaacttatctccaaaaatttttgtaaaaaactgttccacctttcccggctcataatcctcttcctcataaaaagaagaagaataggataatgtctttaatccgatatataaagactctccaaagttaacaactccacgtatgatcggtaagccaagaaccgcataacgacttcccagacttttatactcgtccgtcattacttctatttcatgatctggtttccggacagcaactgcataacggtcaagattcttcatcatgaccccttccattactgcctgtccaccaatacttgtctttttcaaagagcacctcctttcaagaatgcctcacattcttgctacgagatgtgcgttatctcacatctggtataaccaaaattaggcgacggtacaacatcacaacattctctgtgatacattgcaccgccgcctaatttaaaaccttccggttattaattctgattcatgccatatttacgattgaacttgtcaatacgtccacgagccttagcagctttctgctgtcctgtgtagaatgaatgacatttagaacaaatttctacatggatgtcttctttagtagaacctgtaacaaattcgttaccgcagttacatacaacctttgcctgatagtattttggatggattccctcacgcatcttattcacctcttccaatatatgtttcattaattaattatattcaatagttatcttatttcaaacagcgttcttattataccataacagtatgtagagtgcaagaactttttacttctttttaatcaattctttttaattaaatttattgtgattcttaaaaagaatcttacctgcccactccatatcaatcttcataaaaccatctgtagaatgttctttgattgcctctttatacttatcctcaacttgacggtagaactctcttgtcaatggaatttttccaattccctttttctggaaaaagacaagaaaacaataattgtctctgttataatcaaaaagaatatttaacagtgtatcatcttccatctctttcttaatctggtcaagatacatgatcttaatgatctcgatcacacgatcatctaaatgattatcgacaatcataatcttttcttttaaatcattaatattatctacaagacgtttatctatacctttttcctgttcaagctccgcaatctctactttaatctctgcattcatgaccggtgccatgtaaatcataatattttttcggctatccacatataaactgtcatatgtaagcggtgccatatactcacattcttcacagctaaactgataaagccggttcttcataatttcttcttttaattttgccttctctgttacattgataaccttatactttttaagagaatgcttatgcccgcactttggacattctaattcttccatcgcataacttgtcagtctcttgccttccatactacattttcctccaacacctgcagatatatttataaaaaatatctgcctttttctaactcttataataggctgattttgccatacagtcaagaaagaatacacctctcacaaaccatatatttatctctatatatttatctccatatatccatctgtaaacacaaaaaagacttcccggaaggaggaggcatccgaaccttccgggaagtctcttttagtttaaacgcagatcatatttcctatttaacgagttacaatcttttgtttagaaatcttactaaaaatttgcttgccattatactttacgtaagaacgtactttgaaacgatatcttctgtaacgtttgaagtttaaattgtttgttgtgatttttacagaaattgtctttttctttgcattttgtacaactttagactttctatcgcggataaatttcttctttttactgtcatacttatagtattttttaccctcaatctttccaacaagtttaaacttcttcgtctgccacatgtactcatagagctggtatcctttaacattacgttttgttttaagctgaatcattgcttttgtcgttccagctttctttaccgatgtaatcttaggagtctgcggctttgtaacagcaactgcacaattagatacctgtccataaattacttttttatttaaagatacaccatatgcttttacaagatatctgtataccgttcccggtgtacgtttcttatctgtataagcagttttctttgtgttagcgatcacagcatatttctttgtctttgcattatatcgatatactatatagccctgtgcatcttttgcctggctccagctaagtttaatcttttgaacacctttcgctttcgcttttacttttggcgttcccggatgaatatctacatatgtcggatcattcgctccacagtttccgcaaataccattctgatagttgtgacctgttgctggaagtaaaatatctttccactgtaccgccttcatagctgcttcttctaagaacatttccttgcaattttcatcctcacagatccagtattctttgtttcctgcttttgtacaggttggatttaccttatccaccttctttaaggtatgtttgtgggcagtaatatctgtctggatttctcctgtgattcctgaaatagttatcgcataacttccatttttatttttctctaccttaactgaagtgcaatcatccggctgttctttttcttctaaaagcttaccgctcagacagtcatatccgttaatgatcatcttatcaatgcgaacatatttattctctgtgtctggtgttactacaaaggaaagtgttccattttcacgaatgtctgtctttggttctgtatcatccggagttctcttcatttcagaaagcagatatccttcatttgctgtcggcagtgcgtaacctttatacttggcgtattgtacggttacatgtatttttctgtcgagttcttcaatcacgagcgtattggacagttcaccttctacttcttttccgtttatgaaccagcctgctaccataaagtctgcactctttggaactgccgtaaatgtaagagtttttccaccttctactgtggttgtctgatcttttttaagcttaaggtatgtgttgccagctttcgctttaagagttcctgcatcagaagcagcacctttttcatcaacttcgtaagaaacttcatacattgtagctgcatcaaatattgcttctacactatgctctttcttaacttcggaaagagtcagttcagaaccatctgcacttatgcttattccctctgtcgtatctgtgacttctgttccatcaagcttccagcctttgatatgacagaatttattggatactgcagtaaacttgatacttgttccatatgctgctgcaatttctccatcggtcttttcctcagtatctttaccaacaagaagttttccctgttcgttgtttactttataagttactttataagatgcaggaacaagctgtacagaaacttctgtatccttcttcactgtcacttcataggaagcgctgtggctgtcaatcacctgaccgtctacagtccagctttcaacgatatagtctgcatccggtttcacagtaaatgtatatttttcatcgccatttactttatcaccacttgcaacttcacctgccgctccctttgctgtgagcgttccattagaaggctgtgcataggttaatgtaaactgatctttttcacaaacggcctctactttataagaagcaacggtcggtgtttctttcgcaccacttggaacagtaaatgtaaatgtatttgcattttctccgtctacagcctttccatttactttccagcagcttactttataagcttcttttggtgttgcactaaatgtcacctgacttccaccacgtatgtcggctttattaccttcatattctgtgcccgatgtatcctctgctttcactgtaccgtttactgcgctccagcttactgtataatcaatctgtacgaactgtacggtgattgcggctcctgtgcccttctcatcggctgtgtaagtatacgtattgcctgtctgtccatcaacaacctttccatttactttccagcatcctaccttatatccggtatccggctgtgcagtaatatctactgttgctccggcagcaagtacaaatccagattcaatattagcaatctgatctacctttcctgccactgcactgacgatctttccattttctccagcagcgattgttgtgtcacttcctgacttcttaaactgtacggttactgtgtaatcttttgcgatattaggaagagttaaaacagaatccgtaacttttattccatcttccttcaaaatcgtaccattaatacgccattcctgaatagaataatccgtatctggtgctgccgtaaatgtcagtgtacttccttcatataccttttcgccagtagtaagcttgtcaaccttgtaaatgtccatctgctttctatctgcctttgcggttaacgttccgtttgcactctcacccgcagcaattacaggttcataagttactttatgtgttctaagggctttaaatgctccttttacggttacattagctattacattctctaccttataagacttcgtatctgttgtgtttccagatttatcttcatcggtatattctgtttctactgatgtacctaacgcatcctcatcaacaacatagccttttttcggtgttaatgtaacaagcaactgtgtaccatttggaatatgatctccatttgataccgatatatctttgttagcggcatctttgtagattactgtaagagttccattcgagataccgaatggtattgtcacaaccggtttttctttgatagtaacaacaacttctgtattgctgtcaagtgcgtcaagacttgctgctgataaatcttctcttgccttcacgttcttgctccagctagtgacatagtaatcattgtttaaagtgagggcaaattctaccggaatatatgcggaatgactttccccacttgtaatttcctgaccattgcttgtcgctgtgagttctgcaatgtttttatttgttactattgtctcaccaggtttgccgtcatctaatacaaccttatactttaagctgtatttctgggcaatggtaatcaccggacgaatatacagattttcactgatattgtaaagggtaaatgtattacttccgccgcttaacgctgcatcttcccaggtcttaccatccttacttgtctgccacagttttaccatatgatttgtcttatctgctacagatgctgtaaaggtaagtgttgttccttctttaatagatgtaagatctgtcacctcctcttttgtctctgcgttgatcgctgttaccttcgcaagagaagtatcggtctttccatcttcatctgctacactggtaattactttgtaggaagctgtactcttcttaaagcttactattacattttcatccttggaaatatcttcaagaactaatgttgttccaagataattctcgtctttgtcctgccatttgtaaggctttccatctacttgccagccagatacgatatatccatcttctggttttgcggtaaatgttaccttgcttccctgtgtaatcttagttccagaatcaatcttcttatcattttcattaacggctgttaaggttccacctttaccatctacactgtaagtaatctcatgagaggtactcttgaagctcacttctactgtaagaacgccgtcttttgtatggcctgaatttgttgatgctgtctgtgatgccggattaaaggaagctacatctaagctctttccgtctttagaaatcgtcattccttctggaagattctttgcatctactgcgtaatccgttccgttgataatccacttagctacaccatagccactgtttggagccactacaaaacgaagtcttgttcctttggtctggttacttccagatgccatcggataccagttatccgcataacgtccaacaatcgtaccattttctccgcaggagaacttcacctgtgcactatctggttttacagtaaagcttgcacttttaagtgttgctgtataattattctggaatgcttttacttcatccgttaccgcaccattgctgtctgtcttgtaggaaagtataacatcaaacttacctgtcgctgttttatcggtaaaatatccacagttcacattaagaacatcattaaggttcactcccgaaatttccggttccacctttaaagtaatgtcagaagcactagacggggttacaccatttttaatttccggtgtaattgttactgctgcttttgttatctgtaaagctgctgctgcaagttctttctgtggatcaatcgtatctccatcataaacgcggaaattatagcttgctactgataatggctgtgaaacttcatccactttctttctatctttttctgttgtttctaccgtataagtaagattggtcttttctgacttcttccactccccgactgtctgtgtctttgcctcgtctgaggaaacggtaatggctctttcctgaagctcataactaacaattccaccataggtcatggctcctgtcaaaggctttcctgtactggacaatacaagacggtattctgttgtgtttgtctcgtacgttccacccgcattataatactgtgcatcccttgccgatgctgtgtaacctgtgtaaccggatttggcaagaacatttacctgaatgctgtagagaccactcgtagctgctctccaggttgtctttgcttcaccattagaatctgttaccgcactaatcgtattgatagcatttgtctgtgtatttacaatcttaaattctatagaagcacctactgctgcattattactatccttttccattacttttgtatgtaaggtcaaagtagttcctgtctgtgtttcatatatcggagtcttcacagtatttgtaacctgttttgtcacaatatcaagcttcgccggatcaaaaccagaaagttctgtatctcctattgtgtaagtttcttttacatcctcctgaatcgaagtgatcgtatacgttgtcgtttcgccactacttatcgttataagagcaaatccgtactgactctcatcttcgtaagtagtctcctgctttccattcactgtacttgtatcacttactgtataggtttcatttcttccaacaacaactttcgtatttgccttgtggtaaacatcatataatgcatttttatctgcatctgataaagtcacagcacttccaggcgtatctgatgcggaaggatcatatgtatagtatccattatttgatttccagtaatatgtgattcctgtcatggattccagacggctgtcttttgacttaactccactacttcctgtactgattcctgctctctgttttccggtaatctttgcctgaagataataggtaacattatctttcgttacagttacagaatcctttccactgttaaattctgttggaacatctgtaactgcatcaccgtttagattcgtataggaatacttttcagcaaatgtaatcttgtcgcctgcagtgtacgcatcgccgttcttaaccacctgataatatactatattttccttatcatcttttccaataccgtaatacttcggagcagtcttatctccatctgtatacactgttaactccggatgcgtacctgatttttctatcgtaatattctgtgttgtctctatcttttgcgttgttgtacctgtcttcttattataatcagacttgccggcatacggtatggcaagtgttccatctcccgtattatcatgtccggttatcgtaagtttcggggcaaccgcagtttcaccaactgtaagcgtcgctgccttactgtaatattcaataagggaactggcacttgtgtaactcacgcggaaaatacagcgatattctgtatcattatcttcttctgtaagatcattaagtgtaagcttactggattttgctccgtcaatcgtctgccatttaccacctttttctcttctctgccatttgtaattagttgctctgtaatcagaagctgtactggatagatccgccttaaatacagcacttccgccaatctttacacttgcattttctggattagtgatggtgacagttcccatcttctccggaagtgtcgtaacaataagcttctcactgaaaacagattctccggagatcgcatcccctttctttccttctttataagccttaatcgcgtaagtataggatgtatctggttttaatcctgtaacttcgtatgtactctctgttccatcgactgttccgatctgaatatcacttccatcagaataaatctgataaatacgatattcatcagctcctctttctcctgcatcccatgtaatctttgcagaatcagatgttacactctctactgccagattttccggtggagacggaggtgcgataacattcgtaagcacatagccaagaactggtacttctgtgccatttacctttgttgtccaatgcgcaaatttccagttaaaatcatagccttctacctgtttacctgtaactgcaccagtctttgtaatcgcctctgtattaatcgtagactgcgattctgaataggttgtaccagcaccgccgcctgcttttactccaaatacaagtccataagcagtaaacgaagcattcagatcataggtaaatgtcttttcctgttctgtctctgttgaaaattcctgtgttaccgttccttcctttccatactgggtagttattttgctttctgccacattattaagacccgctgtacttgaacggtaagagaatggattgcccggtgtggcaagtgttccatctgcgatttcttccagttcatagctttgagctgcctcattatactcatccaccggaagcatacttgtcagcagagtaccctgtctcgcaagtaccatcgtatcttttgttcctttaatttcataccgatatgttgtaaccggtcttctgtaaacaataacctgattttctcccgtatcattggagtaatttaaggaaaatttctttgtcgtactcgtagcagtctcccaggtatatccctgttctacactcgtctcaaagccggcaccgcatacaaagccggcacagatatcatcaacagaccactcaaaaccagctacgatattcgtggtaagtccctctgctgttgatacagaagttccctctccattctccttaccataagctgtttcactattgccgatatctccctcgtctacctcagaaaagtatggagtggattcaagaagtgcaagcacttccggctctgtatatgttaaagatacgtctttaattcttgcgatcgtactgtctgagtcaatatctggtgcacataaagatgtgtacgcatttcccttcttactaatacgatatcctgttgagttatactgccaggaagatttacctgtctttttgtatgtataggtcttatagaaatattgattttttgatgctcgtttctgacaggttgtaaatacaatctgttccctgccttcttcattgccggaaaaattaccggatactgcatcctgtaccaatccatttgtaatgatagaggtgccaattccattatcactgtgattaaaataatccgtacggtattcctcattaagacccttccctgcttcataggtatatatcgtatccatgatcagtacagaggcttctgcgttcacaccatctgcagcaaaggtatctacaacgaccagcgactgcacatcatctctgtaatgtccatcctttgtaaatccactgacctgtggctgtccattacttcctattgctggcacttcacttttcgcatacgttcctattgcagaattaccttttttagttgttttactacaagatgttacatatgcaccgatatcatgggtcagatctgcatctttatttgttttcttatctacccatcctgctgtgataatctccggatagtccgcaccgctaccggtcataacaagattacctacagaagaagatgcccagcggagtctctggttaccattattatatcctttggtatctaactcaaaagttttattccagtaagacttttcttcctctgtgatattatcataaataaacattctcgactggcggttatttacatccgccttcgtattattcattcctgctgtaacaacaagctcatctacgctatctttgtctgtatctgctgttgtcatctgaacaactggtgtatttctgaatacttttccgttatttgaatgttttgttgctatattctctgtacctaaaatatcaaatatattgcagacagttcctgttttatctaactgcatattatttccgtatgcagttatagagaactcccacaactgaggctgttcactatccgattccatcaacggagcataggctataactgtatcctttccatctccgttaaaatcgcctgctgctacagaaacaaatcctgtatcttcaaatgcatctgcttgttccagataatcaagagttttttcccctccaatagcataagtattacttactctgtttccgtctttatctgcaatataaagctccagacgctttcctccaagccagtagccaagaacagccacatagcgtttctgcccttcaccctctgcatcgacaggcgccgtatccataatggtaaatccgtttttgttcccttcctcttttttacctgtccgagttccgtctgttatgcttccaatggaaccttctttatgatctctgtcattattataattataggtttcaaaacttctgtagccgtcatacccctgtgaaacaaacagttccggtacggtaaaaagattcacccatccttctgttccataagggttattcgccttttcctttttggtatcaatggttgtatccatcttgattccaaaagcatccgtattttcattactgttctcatcctgcgtttttgctgtcgtttccgctgctttcgctggtaaagttacctgcggaaagaatggaatgattaaggctaacgccagaaaaatacttaaaaatcgttgtttcatactatcattttctcctctctccggtcacccgttatttatttctattttctcagaaaattcagattttttcaattaatttgtcgtgaatggcttgtttttgtcgtgaacggtcagtttttttcatttaaaaataaaaagcacacctgcaggcaagcctgcatcggctttctaaccttttgaccctggtatctaataaaaaatatattgttaacctttttatacgcactcggttgacaataagttttttttcttatataatgaacccagtttccatttaacttaacaaatatcatattttagagaggaatttattatgactactgctactgtaaacacaaagaaaaagtcttttacaacttttcagatggctcttattgctgttatggctgccatcacctgtattttagggcctctgtccatcccgattccagtcagtcctgttccgatttctttaacaaatctggcaatttacctgactgtatgtctgcttggctggaagtttggaacaataagttatctgatctatcttcttattggtattgcaggactccctgttttctccggttttagttccggttttgcaaaacttttaggaccaaccggcggatacctgatcggctttattccaatggcaatcatctgtggatttgcttttgaaaagttttctaaccgcggtatgcagattgccggtcttgctatcggtactattgttgcttacattttcggtacagcatggcttgccatcgaagcacatcttaccttttaccaggcattacttgccggagtaattccttatattccaggtgaccttgtaaagattattctcgttgtcctcgtaggaccgattgttaaaaaaagattacaatctgccggacttctcctgtaagcagcattttttctaatacttttccaaaatattttgctatacatttttgaataaaatataaagaaaagccacatgtgatgataattttttatcagtcaatgtggttttttctgtcttttttataaatgaatgtcttcttcacgactttaaattgttttcttttgtaaattgttattattataacgtttttattataatgataataaattatcatttcttttcaaattttttctcatatgatataatcgcttcattgagactatttttgttatcagggtggtagccctgtgaatggaggaaattatgagtagacttgaggtcagaaaaaaaagcaaggcccagttagtcgttgacaatctgtacgaagatctggaacgccgaattattgccagtcctcccggactgtgtcctgttgatatgacagcttctttcctgaaactgtttcatgcacagacttgtggaaagtgcgttccatgccgtatcggtctgggcgttcttgaagatatgttagaagatgtactagacggaaaagccactttagaaacacttagtttaattgaacgtactgcaaaggccatttatgacagtgctgactgtgctatcggttacgaagccggaagaatggttctaaaaggtctggaaggttttcgtgaagatttcatcgagcatatcacgaacggtcattgttcctgtcatttagaacagccggttccttgtgttgctctttgccctgccggtgttgatgttcccggttatatttctcttatcgttgatgaacgctatgcggatgccgttaagctgattcgtaaagataatccttttgttacttcctgtgcacttgtatgtgaacatccatgtgagacaaagtgccgccgtaactttgtggatgatgccgttaatattcgtggattaaagcgttatgccgctgatcattgtggtctcgtgccacctccggaatgctgtgaatctaccggtaaaacagttgctatcatcggtggtggtccttccggtttaagtgctgcctactacttacagcagatgggacatcagtgtactatttttgaacagagaaaagaacttggtggaatgctttactatggtattccgaactatcgtcttccaaaagaccgtcttgcagaagatattcagaatatccttgctacaggtgttgagacaaagatgaatacctgtattggtgatggagatggagagatttcctttaagatgttaaaagaaaactacgatgccgtttatatttctatcggtgcccacactgataaaaagcttggaattccaggagaagatgccaaaggtgttatctctgcgatccagatgttacgtgatatcggagatggtaacccaccagatttcacaggcaagaatgtcattgttgtcgggggtggtaatgtagctatggatgctacccgttctgctatccgtctcggtgcaaagaacgttagtgttatgtaccgacgcagaaaggctgatatgactgctctcatggacgaaatcgaagctgctatcgcagagggtgctgaaattcttgaacttcatgctcctcaggcaatcgaaaccaataaaaaaggacaggtaactgctatggttgctgaccctaagattatcggcctgatcacaggcggtcgtccttctccggcaaattccggaagagagccaatacatatcccttgtgacatcgttattgttgctatcggacaaaatattgtttccgaaccatttgaacgtgccggaattcctgccagacgtggatgtttcttagccgaaaaggacagctctatcgcagaaaaagatggtgtatttgccggtggtgactgtgtaaccggtcctgctactgttattcgtgccatcgcagccggaaaagtagccgctgccaacatcgacaactacctcggattcaatcataagattgaaagcggtgttgttgttccagaacctcgtattgagaacaagacaccttgcggacgtgttactatgatggaaagaaatactacagaacgtaagaaagatttcaatatcgtagaaaacggtatgacctgcaaggaagcgaatcaggaagctcaccgctgcctacgctgtgaccgttttggttatggagtatttaaaggaggacgagttgaagaatggtaaatattaagataaatgacgttcctatctctgtggaagagggaactacgattttagaagcctgcagagaggcaaaaatgattgttccgactctctgttatttaaaagatatcaatgagatcggtgcctgtcgtgtctgcgttgtagaagtaaaaggtatcgaacgactcgtcacttcctgtaaccataaagtaaaagaaggtatggaaatctataccaacactccaaaggttcgtgacgcacgccgaatcaatatcaagatgattctctcacagcataactgtttctgccctacctgtgttcgaagcggaaactgccagcttcagaaagtagcgaacgatcttgagtttggaagcggcactttcaaacagcatattacagaagaaaagtggcctatggactttcctctgattcgtgacgaaagcaagtgtatcaaatgtatgcgctgtatccagatttgtgataaagtacagtctttaaaagtctgggatatcgcaaaaacaggttcccgtactacggtaaatgtttctctcggcagaaatatcaaagaagctgactgtgcactttgtggacagtgtatcacccactgcccggttgctgccctgtccggaagagatgataaacgcccggtattctcccaaaacggtatgttaaatacccgcagaaaaactacagtcgttcaggtagctcccgctgttcgtaccgcatgggcagaagcattccgtctttcccgaaaatttgcttctccagaacgtcttgccggtgcgctccgcttaatgggatttgattatgtattcgatacaacctacgctgctgaccttaccatcatggaagaaggaagcgaattcttagagcgtttaaaacataaagaagactatcagtggccaatgtttacttcctgttgtccgggatgggttcgtttcttaaaatcccagtatccggatatggtagactgcctctctactgcaaagtctcctcagcagatgcagggtgcaattattaaaaattactttgcagataaaatccatgaagaccctgaaaacatcttcagcgtttctatcatgccatgtatcgcaaagaaagcagaatgtgcacttcctacaatggacagcactggaaccggtccggatgtcgatgttgtactgaatacaagagaattcgttgattatatgaagtcccttaatatcgatgtttatggacttccagaagaccgctttgattctccttgcggagaaggaacaggcgctgccgttatcttcggtactaccggtggtgttatggaagccgctttaagaagctgctactaccttgcgaccggagaaaatccagatcctgatgcattccacagtgtccgcggcatggacggctggaaggaagcttccatcgatatcgccggaacagaagttaaagtcgctgtagtaagcggtcttggtaacgcaagaaagttaatcgaagccatccgcagaggtgaagtattctaccatttcgtagaagttatggcatgccctggcggctgtgtaggcggtggcggacagccgatccacgaaggaaaagaaatggctgagatccgctctaaaaacctctacttcctcgattcccacaacgagcgccgtttctcccatgagaatccggaagtactaaaaacttacgaggaataccttgagaaaccactctcacgtatgtctcataagctgctgcatacagaccatcacgcatgggatatgccactggctccaaaattaaagaaacgataaataccaatttgtcggggacacagacgccgctttaatagaagatattgagctgaattgtatggagttttctaaagagaaaagaattgtgataagtttgattttgttccgttgcgctaagcattccattctgcccagaaaaacaggaacttgggaaaaacgaatcccaagttcctatggtcagaattccatagcgcaaagtcacaaaatgcaatacttataacaattcttttttctttatcatagtcttcttacaattcagcaggaaattttatttcagcggctgtcgggttttgataacaaatagaaaattagtgatttctgttggaaagagaaggggattctccagaagattatgagagttaaccagagaaaaaattctccatgaggtaggagtaggtaaatataatttttatacaatcgagtaagaaagtatcttcttctagagatattcattctaatgaaaaccatagccttctggacaatccccattctcaccaactgtagatttgaatagtcagaaaaaagaaaaaactaatacatcccagatgcggcttcggagcgtgtttaagatgcgaacgagcatcttaaatacagcgactacagagcagatgggatgtattagttttttcttttttcgtctacacgaaatctacaaattagtatttgaaatgaaaattttcggaagagaatatatttttgatggacagaatatgtatgtattatatgtcgactctgtctggaacaatgatgaaaattcacttttaattaggggaaaatcaaaattaaactcaagaacaagaaaactgtaaatttccatgttgacaccataaaatatgtatattataatgtaaaaaaggaaataaataatatgaattcagtttttgaccagttataagaaagggtaaacgataatgattaatgtgattattgatgaatttactccttgtttaaaagatgcaaaaactggggagttggttcaaacagaagtaattcgtatcaagagaaaaactttcttaagaaaatacaacagaaaaactggttggtatataaattgggcttctttgattgctgaaaatgaaatatatgcattggttgtagaaggttcagtcgatatacaaggcttagtagcagtagctccggataaaaatacaaatgcactatatattacctggatgtgtgcaagtccagataataataagttactatctgaagatgttaaatattttggtgtaggaggacatttatttgcaattgctgcacagaaatcattagaatatggatttggtggatttatgtatggatttgctgcaaatcaaaatttgcttcagcattacgttgaagtgtttaacggggaaataatagcgatgttacacccttatcaatttgctattgatgaggagaatgcgaaaagaattatggagatgtatgattatgactggacagatgacgaaatataaagaatctttaagacatatgccagaacctattatgttaagccaaattcaaaaaaaagtggatttaagaggattgatgaactatgccaaagaaaaaggaataaaagtaacacagttaactaatgaagaaaagaatagatttctgctttgatttccttctaaatcatccaatattaaccagtaatttcagtttccgaaaccaccatcttcataaataaaatcctttcgtttgccataggctcctcccactacctttaggtggtgggaggagccttgttaactgttacccaatatgctacaatagccgtagcagttcttaaagagaaaaccgttagatgtgctgctcattaaagacactcttttgtacattg

SEQ ID NO: 436 - DNA, 29382 bp, Eubacterium hallii
aatgttcaaactatgggaaactatggtgttgtccaccatatacatttgatgtggagaaggattattggaataagtatcgtaaaattcaaattatgggacgaaaattatatctgccaaaagaacttacaagtaagtcctatgtggaaaatgaacaatggaaagtaacagaagaatttctccgcccttataaagaggaattagaagaggaaatcttgaaattagaacagaaatattccggaagtatttctttaagtagtggggcctgtctgcattgtaaaaaagcagaatgtacacgcgtatctggtgaaccttgccgttttcaggataaaatgcgttattcaatagaatcattaggaggaaatgttggcaaaacggtaacaaagtatctgaatcaggaattacagtgggtagaagaaggaaaactcccagaatattttatgctcatttatggactgttgattttgtagattttgtagatttggtgtagacgaaaaaagaaaaaaggatatattccatctgctctgtagtcgctggatttaagatgcttattcgcatcttaaacccactcccaagccgcatctggaatatatccttttttcttttttctgtttaatctgaatttgcaatttaataatagatatttcttcagtgactgtctaatatcatcccagaaatcagttaaaaaataaaaggtttgtttgtcctaaaatctatggtcttcgtttaaataaaaatctgtatatcaaatgtgagatgattcctatctcgcaataagaatgccggggcatccttgaaccaaccatttgaatgtcaatcctttagaatttaattccatggatagccgtatccctctggagaattcccattcttaccagctatggatttgcgatagtcagaaaaaaagaaacaataccatatcccagatgcggcttcggagcgtgtttaagatgcggacgagcatcttaaacacagcgactacagagcagatgggatatggtattgtttctttttttcgtctataccaaatctacagatcagtattattcatatagtggaaaacttccggattcttcttcgttgaatacgtagtatacggcgttctcttctggtttcaggtataaatccatcgtttttaaatctttaactttacggtctttattacctgcatctacccagactttttttgcttttgcaataacctctttgctttcaatttggtttcctgcaaattctacattatatgttgatttcatttatgtatcccctttcctgattggaattattataatgtactatggttacaaatatcatataacaaatcttaccaaaaatcaatgatgaaatttcgacaaggaatgaagatagagatttgaattttttatagataaatcttgcaaaataaatgtttttcaactagaataaaaaggaatgaagtacaggaggatgaagaagatggttgcaattatcgattatgatgccggaaatattaaaagtgtagaaaaagcattattgcatcttggagaagaggtaataatcacacgtgatcgtgagcagattttaaatagtgataaagttattttgccaggggtcggagcatttggagatgccatggaaaagcttcgctcatatggacttgataaagtgatttacgaagtagtagagagaaagattccatttttggggatttgtcttgggttgcagcttctttttgaaaaaagtgatgaaacaccaggtgtaaaaggccttgggattttgccgggagagattttaaggattccggataaagagggaattaagattccgcatatgggatggaattctgttaaaataaaagaaaatgcaaggatttttaaggatgtcccacaggactcgtatgtctatttcgtacattcttattatctaaaagcaggaagagaggaagatgtagcggcaacgacagagtattctacattaattcatgcagctgtggaacatgacaatgtatttgcctgtcagttccatccagaaaaaagtagtgagattggtctgaagattctcaagaattttgtggagttataaaaggagatagatatgtttacaaaaagaattattccctgtcttgatgttaatgacggcagagtagtaaaaggtgtgaattttgttaatttaatcgatgctggagatccggtagctattgcagaagcatatgataaggccggggcagatgaacttgtatttctcgatataacagcatcttctgatgcaagaaataccgtagtggatatggtgcgaaaagtagcagaaaaggttttcattccgtttactgttggtggaggaatacgaacagtagatgattttaaagtaattcttcgtgaaggagcagataaagtttctgtcaattcagcagcaattgtgcgaccggaactgatcagcgaagcagcagataaatttggaagccagtgtgtggttgttgctattgatgcaaaaagaagaaaagatggcggctggaatatttttaaaaacggtggaagagtggatatggggcttgatgccgtagaatgggcgatgaaagcagaaaagcttggcgcaggagaaattcttcttactagtatggattgtgacggaacaaaagcaggttatgatttagaactgacacgtatgatttcagaaaatgtatcgattccggttatcgcttccggtggtgcaggaacaaaagaacatttttacgatgcatttaatgaaggtaaagcagatgcagcattagcagcatctttatttcattttaaagaattggaaataatggacctgaaacaatatcttagagaaaaaggaatttcagtaaggatataagatagatatatatagaaggatatgaaccaattgtggatttaaattagacagaaaaaagaaaaaataatacattccagatgcggcttcggagcgtgtttaagatgcgaatgagcatcttaaatacagcgactacagagcagatggagtgtattattttttctttttttgtctatcctaaaccaacagttggtataaaatcgtagacttttggacaatcccctctttcccacagacaaaaatacggatttcatctggagccaaagaacgtaaaaaccagaaatattatatagactaaaatgtgatgtcggagcaagtaaaaatgccggtcaggcattttctacgccgcgactatcttcacattttagtctatataatatttctggttttcgtttctttaacctatcaatcagaatttttgaaaatactttttcgtttcggccacaactacaccatttaaggcaagaagggcaatcaggtttggaatcgccataagaccatttacaatatctgcgattgtccatacagcagaaacagtcatgtatggtccgataaatacgcaggcaatgtagatccagcggtaagtacgaactacttttttattgtttcctgtaagatagtcaagacatctttcactgtagtagtcccatccgagaatagtagtgaatgcaaagaatacaaggcagagcattaagataaaagcagatacccttccagggaaaggaagtccaacctgaaatgctcttgttgtaacagcaacaccttcaagtcctttgtcccagcttccagtgatgacaatagaaagaccagtcattgtacaaatgatgatagtatcaataactgtaccgagcatagatacaagtccctgtcttactggttctgtagtctgtacagcggcagcagcaattggtgcacttccgataccggcctcgttagagaaaataccgcgggcaatacctttttgcatagcaagcatcatagcaccaagagcaccaccggcaaccgcacgcataccaaaagcactctgaacgatttctacaacagcgccaggaatcgctttatagttaaggattaaaattaaaacagcggcaatgatgtaagcgacagccataaatggaacaacaacctgtgctacagcagaaattcttcgaagccctccgatgataacaaaagcaacgaaaatagttaaaataattccggcaatgactactgtccaggaatattctcgtccaaataactgtactgtccaggcattgttttcatcaaagaaattatttaccgcactggtaataccattgatctgtgagaaggtaccaatacctaaaagacctaccataacaccgaaaacagcaaagattttcgcaagccatttccagttttcacccatacctttttctatgtaataaaatggtccgccgacaatatgtccatcgtctgcaaccgttctgtatttgatggcgagaagacattcggagtactttgtagctgtaccaacagtggcagcaacgatcatccagaaaagtgcacccggtccgccggcaacgatagccgtagcaacaccaacgatgtttccggttccgatcgtagcagaaagagcggtacataatgctccgaaactggaaatttctccatgttctccgtccgtttcattagagaacatgtacttaaaagcgaggataagtttacgaacctgaataccttttaaacggattgtcagaaagataccggttgccagaatcatgacgattaacgggacaccccatactaaatcgtcaatctttgttaagattgtgttgattgttccaaacatattacttgttttgacagactatgcctgattgcataaaaggcataattctatctttcctttcttaatagatttttctgtgtgaaatacaatatgaataaccatattacaattgattctcctgaaaaatcatctcggaaaaggggaaactgcctttgcaaagtaagaatctacagttttctaaagacacaaaaaggactgatacccatcatcagccctcaaaagagttaaacatgcatatatagtgccctgtccttttgcctgagagattagcagatatactgccgtacaccttcggcgctttacatcgcggtaaagactctccagagagtaatgctgtattgttatatagcaaacaatactaaagtatcataaaataaaaagtatttcaatatgtttttttaaaaatgcaagaatatgcagggaaaattgcaaaataataaagttttctaatcgagtgatgcaagagtagaacttgagataaaagaatattgttgttataataatgttattataatgtagaaagtgaaaattaaaggagacatttgacagatggaaggacagttaaaaaagaagctgataaagtatttattagaagataaagtctgtaatctggtgacagaaattttttcaacagaaggagagagtgttccggcacctaatacagaagtttttttgcgaagaagtattatagagccggcagaacctggattttcttatcagccgcttcttttaaaagaggagaatacactgagattttttgagccgattgcgaaagaagaacgtctgatcattcttggaggtggccacatttccaagtatctatgtgagtttgccgcaaaaacaggatttgctgtctgggtgatcgatgagaggcaggaatttgccaacaaggaacgttttccagaggcaaagaatgtaatttgtggtgagtttaaaactgtgcttccggaattacatattaataaaaatgattatgtggcaattgttacgagagggcatagttgtgacggggactgcctttattatattttaacgcatgaaatgccgggatatcttggcatgattggttccaaaagaagagtaagtgcccagtttacgatgtttaagggcatggggatttcagaagaaaaaatcgcccaggttcacaatccgatcgggctgccgattaaaggggtaacgccgccagaaattgcagtatcgattcttgcagagcttattttgacaaaaagaacgaaaaagacagatggaaaagtgcagacggaattagattatgaagtgctttcagagtggctttcacaaagtcgtccgtgtgcaatggcaacaatattaaaagcacagggatcttcgccgagaaaagaaggggcaaagatgctgatttttgaagataagtctattttgggaagtgttggaggtggtctggcagaaagtaaggttattgaaaaaggatgtgaaatgatcggaagcggaaaagcttttctatttcattttgtcatggatgcagatgtagcagccagagttggaatggcatgtggcggtacatttgacatattgattgaagatgttaagttttgaccccaacattatagcatataaatataaaagaggaaaaaagaatgaaattaatgaaaacacaggatgcagtaggtcaggtattgtgtcatgatattacacagattataaaaggagttacaaaagacgctgtttttcggaaaggacatgtgattacggaggaggatattcccgtattactcagtgttggaaaggataacgtatatatttgggaaaaaggcgagaagaaactgcatgagaatgaagcagcagaaattttaagagagatgtgtcagggagagtatatgcatccgacaccagtaaaagagggaaagattgagctggtggcagatatagatggactgctgaaagtaaacagtgataaaatcaaaaaagtaaatagtatgggtgagatgatgattgcttcccgtcatggaaattttgcggtaaaaaagggagacaagcttgccggaacaagaattattccgctcgtgattgaaaaagaaaagatggaaagtgcaaaggctgtctgtgaaggtcagaccattctttcattaaaaccgtttgtccataaaaaagttggaattgttactaccggaaatgaagtatattatcacagaattgaagatacatttacccccgtaattaaagaaaaactggcagattatgatacggaagtgatcggccaggtagtctgtaatgatgatcatgagaagattacaaaagcaatcctttctctcattgaaaaaggagcggatctggttctttgtacaggtggcatgagtgtggatcctgatgataaaacaccgcttgccattaaaaataccggtgccaaaattgtttcttacggagcaccggtactgccgggggctatgtttttattaagttattataatgaagatattccgattgtcggcctgccgggttgtgttatgtatgcaaaaagaacgatttttgatctggcgcttcctcgaattatggcagatgataaaataacagcagaagaactggcagaattaggagaaggcggactatgcttaaactgttccgtttgcactttcccgaattgcggctttggaaaataaagaagaaaaataaaaaatagaaatagaaaatagaaacaaaaaatagaagaaaaaatagaagaaaaacataagaaagaaaacagaagggaaaaaacatggagtatacgcattttgatcaaaatggaaatgcagttatggtagatgtgagtgataagattgaaacaaagagggcagccgttgccaaaggctcgatccgtatgagcagagaatgttacgaaaaaataaaaaatcaggatatgaaaaaaggagatgttttgggagttgcccgtattgccggaattatgggggcaaagaaaacatccgaattgattccgttatgtcatattttaaatcttacttcaataacagtggattttattatgcaggaagaaagctgcagcgtaacggcagtatgtgaggcaaaaactacagggaaaaccggagtagaaatggaagcactgaccggagtgcagattgcgcttcttaccatttatgatatgtgtaaagctgtagataaaacgatggaaatttatggtgtttgtctgtgcagtaaatcgggtggtaaaagtggagatgtcgtataccgactgcccgaaggagaatagcaatgcgttatcagattgaaaatggaacagtttcccttggaggaaagacagttcttgatcatattgatttttctgtaaaaggtcgggaaaaagtagcggtcgttgggcgaaacggagcagggaaaacgacacttttgcgtctcatcagtggggaattatctcttgacagagatgataaaaactttggaaaaggaataaagaccgatcgagaactttcgattgggtttttgcatcagcaaagttttcaggatgtagaaaaaacggtagagcaggaaatcatatctcttattaatgaagaggatattttttcgagagagcggtattattttgaaaaagaatatgaccggatatttactggatttggatttcaaaaagaagataaaaagaaaaagatcaaacagttttccggtggggagcagacaaagttagcacttatcaaacttttattatcaaaaccggatattttgttgttggatgaaccgacaaatcatctggatatagcatctgtagaatggctggaagagtatctgacttcctatgaaaaggcagtcattatggtttcacatgatcgtttttttgttgatcgcacaacagaaattatttatgaacttgccgatggaaagctgacacgctatgttggaaattatacagaatataaaagacaaaaagaaaagcagcgggaagtgcagcaaaaaaaatacgatgcacagcaaaaagaaattgcgagactaaatgaactgattgaaaagtttaaacataagccgaaaaaggcatccatggctcgctcaaagaaaaaagtattggaacggatgcagcgggtggaaagacctgataaagaagaggcatatgtttttaaagaaaagttagaaccgattacattgggagctaaaaatgtattagaaacagagcatttaaaaattggatatacaatagaacatccgattaaagaactcactttgcgaatacgacgaggacaaaaaatcgctgttcttggagcgaatggagcgggaaagagtacatttttcaaaacaattattggagaactgcctccaatttcaggaaaatacgtgattgggaatggaattatgacaggatattttgaccagcattcaggagaaatatcttcggaaaaaagagtagaagaatattttggagaatgttttcctaagttgacagaaaaagaaaaacgtcaggttttgggaaagtatttatttcgttcacaaaaagcaaatatgaaaatatctgatttatccggaggggaaaaaagcaggttagtattagctgaaattcttgaaagccgtccaaactttctggtgctggatgaaccgacaaatcatatggacctgccggcaaaagaaacgatggaatctgcatttgcagcgtataccggtacgatgctctttatttcccatgacagatattttgtcagtaaagttgcggatgcccttttattatttgaagaagacggagtaaagtattatccgtttggctatgaacattaccttcatatgttaaagaaaaaaagagagggaacccagacgtgggcggaggtagtagaagcagaaaatacagcgttagtagaaggactttttgctgtgccatcaaaagaaaggcatcagactgcaagatttagtacagaacaatcctatacagactggcagctggctcttgcaaaagaagagctggaaaagtatgagatacagcttgaaaaacagcaggaagaaatagaatcagcagagcagaccgttacttttgaagagtatcaatcgggtaattggaaaataaaaaaagaagaattgcaaaaacagtttgaaaaaatagaagaagaataccaggaacaatgtctgatctggtatgaaaaatggcaggaatatgaagaagcttttcttgactatgtttaaaagaaggaaaagtgaaaagaaaaaaggaaaaagaaaaagtgagttttacataaaaaagctatatatcctctgtacgcttttgaagcacaggggatatatagcttttttattttttaaaaatttttattttagcaatcagtatttaactttttttgtgctgttgccaacatcagcttgattcgattaatctggtttacttcacttgctcccggatcgtaatcaattgctacaatgttagattctggatatttacggcgaagttccttgataacgcctttaccaacaacgtggtttggcagacaggcaaaaggctgggtacagacaatatttggtgcgccctgtttgataagttcaaccatttccccggttaagaaccatccttctccggtctgattaccgagcgatacaataggttttgcgtattcggcaagctctttaatatgaggtggtgcagtgaaacggtcgcttcgctctaattcttttcgaaggaagcctcgataagcctccagtgcagaaattgccatgttacataacttagcagccttagcagactttccaaggtactctgccttaaaattactgttatagaaagagtagaacataaagtctaataaatcaggcattactgcttccgctccttcttcctctaaaagttctaccagatgattgtttgcatccggaaggaattttacaaggatttctccaacgataccaacacgaggtttcttttcatcggtaattggcagtttatcaaaatcatggatgattccacgaatatttttcttgaattcaccgtaacgtgccttttcaagagatttaatacaacgcttcttccacacttcgtgtaagtggttcgcagaaccttttaccttctcatatgggcggacgcggtaaagaacacgcataaataaatctccgtagataacaccctggagtgcgcgaactaagagcgcaggcgtaaacttaaatccttcattcttttcgattccctgtacacttaaactgataactggaatctggccgtagccattcttttctaatgcacgacggatgaagccgatatagttcgttgcccggcagccgcctcctgtctgagagataataactgccgttttgttgaggtcatacttaccggaagttaaggcagtcatgatctggccgactacgataagagatggatagcaggcatcgttatttacatattttaagccggcatctacagcgtgttttcccatttccggcagaatttctacatggtatccgcagtggcggaaggcaggagtgagcaggtcaaaatgaattggagacatctgtgggatcagaatcgtgtaatccttcttcatttcttttgtaaactctacttttgtaatatttgccggaaccggatgtggctcgatgtgcttacgatttctgatctttaccgcagcaatcagagaacggatacggattctggcagcgcctaaattgttaacctcatcaatcttaaggacagtgtaaatacgtccggaattggtcataatatcatttacctgatctgttgttacagcatcaagaccacaaccgaaagagttaagctgaataacttcaagctgtttattcttctttgcatagtttgcagcggcatacagacgggaatgatacatccactggtcagatacgattaacggacgttctacatgacctaaatggcagatagaatcttcacttaatacggcgatgccgaaagagttgatcagttccggaataccatgattaatttccgggtcgatatggtatggacggccacagaggacgatacccattttaccggtttcagcaaggtaagcaagagtttcttctccctttgcctgtacatcttttcttactcgagaagcttctttatatgcttcttcaacggcatggttaatttcttcttttgtcacatcaaaatgttttgataattcatcgtacaaacgtacttttaaagcttcttcgttatcaagtgccaggaatggattcataaagagaacatccgggtcacgaagttcttccatgttatttttaatgttttctgcataagaagttacaatagggcagttatagtggttgttagaaccctgcatttgattctcttcataaggaacacaaggataaaaaatagtgtggattcccttttgcagtaaccacataacatgaccatgcgcgatcttggcaggataacattcagactcactaggaatggattcaataccaagctcgtaaatctttctggatgactttggagaaagcataacccggaaggaaagatttgtaaaaaatgtatgccagaatggataattctcatacatgttcaatactcttggaataccgatcacaccacgctttgcctcgtctggttttaaagatttatatccgaaaatacgtttatatttatattcataaaggtttggtacatgttcgtgatttttctcaagaccaagaccacgttcacaacggttaccggaaatgaattgacggtcgttgttaaacttattaatagtaagaatacagtggttgttacatccctggcagcggctcatggaagtagtgtattcaagatggatgatctcatcaatagagagcatttttgtatcacccgtttcatcttctcgctctcgtgcgattaaagcagcaccaaaagcgcccatgataccggcaatatccggacgaacagcatgacagccggatatacgctcaaaactgcgaagaaccgcatcattatagaacgtaccgccctgtacgacgatttttttaccaagctgttttggatcagtaagcttaattacttttaataaagcgttacggataacagaataagcaagaccggcagaaatatcaccaacacttgccccttctttctgtgcctgctttactttggaattcatgaacacagtacagcgtgaacctaagtcaattggagacggggcaaacaaagcaaccttggcaaaatcagcaacagaataatttaaggacttcgcaaaagtttcaatgaaagaaccacatccggaagagcaggcctcatttaagagaacattatctacagcgtgattgcggatcttaatacatttcatatcctgaccgccgatatctaagatacagtctacatccggttcaaagaaagcagcggcataatagtgtgccatcgtttctacttctccatgatcaagctgtaatgcggctttgatcaatgcctcaccgtaaccggtagaacaggaaccggaaatcttagcagaaggaggaagaagttcttttaactccttcatcgcacgaatcgttgtgtttaatggacttccgttgttattatcatagaaacggtataaaagagaaccgtcctctccgactaaagcaagttttgttgttgtggaaccggcatcaataccaagatagcatttgccgctgtatgtagctaaatctgccttttttactttgaactgattatgctctttaataaatgcatcatattcctgttcatctttaaaaagaggttccatacgttcgacttctacagcaagctttatatcagattcgaattcttttaaaagctcatccattgtaaaaaagcattcttcctttgcattaagagcagcgccctttgcagcaaaaagatgagaatatggtgggtctataatatgttcttcatctagattcaaagtacggataaaagcattctttaattccggcataaaatgaagaggtccgccgagaaatgcaacgtaacctttgatcggcttaccacaggcaagaccactgatcgtctggtttactactgcctgaaaaatagaagcagcaagattctcttttgtagctccttcattaattaaaggctgaatatcagactttgcgaaaacaccacagcgggcagcaatcggataaagcgtatcgtaattacgggcatattcattaagaccggtagcatctgtctgtaaaaggctggccatctggtcaataaaagagccggtaccaccggcacatacaccattcatacgctgttcaattccgttattaaaataaataatcttggcatcttcaccgccaagttcaattgcaacatctgtttttggctcatagtcctgcaatgcatttgccacacagactacttcctgacaaaacggaatatgtaaatactctgaaatagacattccaccagaaccggttaccgtcggatgaattgtcagattcccaagtttcgctctggcttcagataataaagtttgtaatgttcctttaatatttgcaaaatgtcgtttgtaatctgaaaaaaggatagcatggctctcatcaatgacggttaccttaactgtagtagaaccaatatcaattcctaatgcgtgtttcatgattgatcaatcatctcctttagtaaaatgtgtattaataataaggtaagtaattttccaaatatccaaactattataaacgagttggacgtaaaatacaacaaattttgaaaaaagattccgaatgtacctatttgggtatggcgggaacatcttttgtaacagcatcatattttataattgaggaagtaaaaaggaagagcatttatgagcgaaaaagtgtatgtaaacatatgtgacaagagaaaatgtcccggtccggtatatgcggtaaaaaaaggagatacgctttattctattgcacagaaataccattgccgggtacggacgttgcttgatctgaatccttttgtagatatatataatttacagcccggcgaagaaatctgcgtgccagattgcaggggacagggaaaagtagacttccggccgtatgtagtaaaagaaggagatacattaggaggtatcctgaaaaatgtttcgatgagttttgaagagctggcaaaggtaaaccggatattatataaccttattgtaccagccggaacgattcttttgataccaggtaaaaaagaggaaaaataacagaaatgcgtttgacaaagtattagatatttcttataataaaatcaaacggtttcagtcctgtaagagtccgcgaaacggactctttctttcgttttgacaaggtaaaaagtataagatgaagactaagattaagactaagataaagaagcaccggctggaatcttataaactgttgaaagagggaagtctcatgataagaatttttaaaacgaccgattcggggattcgcaaggttgcagtggcagaagaaggatgctggatagctcttaccaaccctacgtcagaagaattaactacgatagcagaccagttcaacattgatgttgacgacttaaaaagccccttggatgaagaggaacgttcccgtatacaggtggaggagaattatacattaattatcctggatattccgacgatagaagagcgtaaaggcaaggaatatttttatacgataccatttggaattatctttaccgataagtatatattcaccgtctgtcttgtagattcaccggtattgaccgtatttatggatggaagagtgaaggatttttatacgtttaaaagaactcgttttatttatcagatgctttatcgtaatgcaacgatgtttctgcagtatctgaagattattgacaagaaaagcgatgaagtagagaagaagcttcatatttctcagagaaatcaggaattgatagagatgcttgatcttgaaaagagccttgtgtattttacaacatctttacgaggtaatgaagttgttcttgagaagctgatgcgtaacacatcgattccacgctatgaagatgacgaagaattgttggaagatgttatcattgaaaataaacaggcaatagagatggcaaagatttacagtgatattttaagtggaacaatggatgcctttgcctctgttatatctaataacttaaatattgcgatgaagtttttatctgttatcacgatcgtacttacagtgccgacgatcgttacaagtgcgcttggcatgaacgtcagaggaattccttttgcaaataacccatatggtttctggattgttgtgggaatctctttattgatgactttagctgccggggcgatcattgcaaaaaacaaacattttaaataaacaggatgcagccggaatttccggctgctgatgtttatatcataaaaaatattaaaggaggcgtgctatgaactggctagacaagctggaacgtaaatttggaagatatgcgatacgtaatctgccgctgtatattgtgatgctttatgcgataggagcggtgcttaatattatgacaaagggttcttattactattatgttgcattgaacccgtatatgatacttcatggacaggtttggagactgcttggtttcctcattgtaccgccgaatgccaacattatttttattatatttgtattaatgttttattactccataggggaatcgctggtgcaggtatggggagcattccgttttaatatgtatattttcctcggagtgatcgcaacaattgcagcatcctttgttgtatattttatttatccgtctacgatgatctttatggatacattctatttgaatctgtcgatgtttttagcatatgcaacgatttttccggagatgcgagtatacctttatggaatcgtgccggttaaagtaaagtggctggcatgggtggatgttgcactcctagcatataattttatgactggcaatataggatctaaagttgcgatcgtagtcagtttactaaactttcttttgttctacatttcttcaaggaattataaaagagtttcgccaaaagagattcaaagaaagcgggcatatcgtaaagcatcttccgcggtatcaaataagccgtatcgtcataaatgtgccgtatgcgggaagacagaacttgatgaccctgatttagaatttcgttattgttcaaagtgtaacgggaattatgagtattgtaatgagcatttatttacacatactcatgtaaaataaaaagtgacaggaggcggtcttatggtgactatatcggaaaacatcataatcggtgagacgatttcccatgatgcgaaaagtatcttgcggggagtccgccatccttttatatggaagaaaggactctggtatggaatcactacttcctgtagtggagatacgatcatgtatgtgctttcgtcaagagagatgcggcagaagttttatcaaaataacaatctacgattgctgggaatagcaggttctataaaagaagcgtacgagattgtgttaaaacttgtgcagacagggtataataatgattgtatctacgagatgaaggaatatctggagaagttttaaaacaggagggaaaatgtgctgcatgtattatttatattattgaaaatacttgggatactgctcctgttgcttgtcggagttttactgctcgtgctgctggcatctcttcggtattcttttaagttagaaaaagaagagcaggtttcgcctgagttttcggtaagggttacctggctgtgctggcttttttattttaaggccagctacatagagaaggtatttgattatcgaataagaatactggggcatcagattgccggaaatcaaaaggaatttcttgaaaggcaaaagaaaaaggcagaaaaagcgcaggaaaaacgtagaaaagaaaaagagaacaggaagaaggaatcacagaagaaagaaaaagaactgcctgttacaatatcagaagggaaagtctctgcaacagaaaaaccggaagaagatctcctgaaagaaaaagagtcagaaggaagttacagtggggagagcgtaaaggatgcggcttcccataaggaattatcaacagaaaaacaggtaaaagaaaagacagacaaatcatcaaaaagaaaggattccttttttaaaaaagggaaagcgagaataaaaagtttaaaagatgcaaagtctaatttagatcaatttccatggagagagtggctggagcttggaaaggatattgtgatttgtttctttaagcatgttcttccacagaaactccggggaacgattacttttggatgttctgatccggcatatacaggatatgtgaccggaatagctgctgtgttttatccgaaatatggagagagtttttctttatatccggattttgaacgcaaggtgtttgcggcgcagtgtgaaggaaagggaagaatccgactgggatatatacttgttctggttgtttctatattaagagaaaaaagtgtgagaacaatgattaaacgtatgattttagattaaacaggagggtatactatggataagcagaattttgatacaacagtgaattctttatttggtggaatggatcatgtattatcatcaaagaccgttgtaggagaaccacaggtgattggagataccattatccttccacttgtagacatttcctttggaatgggcgcaggagcttttaataaagaaaaaggaaacagcgcaggtggaggaattggtggtaagatgtcccctagtgctattttagttatccataacggacagacaaagcttgtgaatatccgagaccaggatgcgataacaaaggtgcttgatatggtgccggatgctgtgaataaagtggtttccattattaaaggcgatacggcggagaataaagtagatccggaagtggaagcggctgtcaataaggcagcacaggcggagagttccgtagtagatgttgttgattccgaaaaaaagtaaagatttttaaaagttttccttgcaatttgttttgatttctgatagtatagactcgttgtaagtctgtcagacttaagtatattcgcgaggaggtgctatcatggcaagatgcgctatttgtgacaaaggtgctcatttcggtatcaaagtgagtcattcacatagaagatcaaacaaaatgtggaaatccaacattaagtctgtaagagtgaaagtgaacggagcttctaagaaaatgtatgtttgtacttcttgtttaagatcaggtaaagtagaacgtgcgtagttttactgtcactgaggatgaaagaagactctaatctttgtccttacaggaatgtatgcagatatgagttaagggggaatcagtgattccctcttttttctttatatgtactctcggaatcttctcataaaagcaagagcagtgaaggcttcgagagtacatttgtcagacatgctcacaaaacagcagatatcctaatagggtactgataaccagaagaataaattttactgcgaaaccggtgagaaaacagcttaggaacagaccgaaggaaaaacaaaaaagagcgaacccgcataattttttcataaaactcccccttatgttccttataatactatatgagtatgcagcagttttgtttcatcttatataatacaaagttaagatgcaaaattaagatacggaatgggagatttttatatttgtggttccaatttcaccgaaaagaggttatactatataaaacgataataaacggagggatagtatatgaaaggacaaatgcacaccgatttaggtcaggttattatagatgaagaggttattgcaacttacgccggaattaatgcattagaatgttttggtattgttggaatggcatccgttaatgtaaaggatggttttgcccagctcttaaagagagataatgtaagcaaaggtgttcatattaaggtgaacgataataagatttatatagattttcatattattgtagtatacggtgtctctattgctacagttacagagaatttaatccagaatgtaaagtatcgtgttgagaagtttaccggtatgagtgtagagaagatcaatatttatgtagagggagttcgtattgtagattaagtaggaatctgcgttgaattttcttttcgtaaaattttgtaaaagaataaatactaagaataaaagaattaatataagaataatagataaaacaggtaaataaggaggaaatgttgtgaacagtcacaccatagatgcaaagtcttttcagaagttgtttttagctggtgcaaaccgcatcaattcacgaaaagattatattaatgaactgaatgtatttccggttccggatggagataccggaacgaatatgtcactgacaattttagcggctgccaaagaagttggagcagttgaagaaccgacaatggctacgatctgtaaagcgatcagtaatggttctcttcgtggagcacgtggtaactctggtgtaattctttcccagctgtttcgtggctttaccaaggcagtttccaaggcggattctcttggaaaagatgagattacagcaggatttacaagagcggtagagacagcgtacaaggcagttatgaagccaaaagaaggaacgattcttactgttgcaaaaggaatggcagataaggcagaagaattagtggatgaagatatggatgtgatcgaattctgcgagacaatcgtagcatacggttacgaagtcctttcaaaaacgccggatatgcttcctgtattaaaagaagcgggcgtagtagactccggtggacagggtcttatggaagtgttacagggaattgtagatgcacttaccggtaaggtgacagagattgaagttccggcagaagcagcgtctatgtcctctgcagttattagcgcaccaaaggcagatatttccacagcagatatcaagtttggttactgtacagaatttatcattttattagataagccacttacaaaggaagacgagaagggactgaagaagtttttcctttctatcggtgattctttagtattagttgcagatgaagagatctgtaaagtgcatgtacacacaaatcatccgggtcaggcatttgaaaaggcattaacatttggtgctctttctaatatgaagattgataatatgcgtctggaacatcaggagaagctgattaaagatgctgagaatgaggcggcccgccagagacagcaggaagcggaagaagaaaagcttaccgcacaggaagctgcaaaggcacagcctgcaaaagaagtaggatttatcgcagtttctgctggggaaggccttacagatatcttcaaaggtcttggtgtggattaccttattgaaggtggacagactatgaaccctagtacagaagatatgctgaatgcaatcgatcaggtgaatgcaaagaatatttttattcttccgaataataagaatattatccttgcagcagagcaggcaagagatttaacagaagataagaagattgttgttcttcctacaaagaccattcctcagggaatttcagcgatgatcggatatatgccggaggcatctgttgatgagaatgcagagaacatgaaagatgcttgccaggatatagcaagcggtcaggttacttatgctgtaagagacacatcaatcgatggaaaagagattcataatggcgatatcatgggaattaatgatgacggaatcgcagccgtaggaaaggatctgatggaaacaacgattgacttactttccactatggtggatgaagattcagagctgatctgtctttattatggagcagatgtatctaagcaggatgcagacgcactttctgatgaaatcgaagagaagttcccggaatgtgaagtagaagtaaactttggcggtcagccgatttattattatatgatttctgtagaataagcatagcattacaacagcgatttcgtgaataagacatggaatcgctgttgtttttgaataagtaagaaagcaggaaggttacaaatgcagatggatgaattttgctatttgactttcctgctttttcattaaaaaagaaattcttgaatccgagagtatatgaatctgataaggaggagccgggatgggaatacccgtaagagaaataaaagggattggagaaaagacagaaaaactgcttgcaagacttgagattgagacagtggatcagttagtgcatcattatccgcgctgttatacaacgtatcctgagccgatcgcgatatctgatataaagacaggacaaagatgttctgttgaggcggaaatctcttccccgattcatttgaaaacagtgcgtaaattaaaactttgtacagggcttattgccgatgtcagcggacagctttttgtacgatggtttaatatgccctatctgcgaaatacattaaagcagggagaacggtggatttttacagggactccaatctacaaggacggccgccttatgttcgagcagccggaatattgtaaaaaagaaaaatatatacagttaatggaaacatttcaaccgatatatccgcttacaactgggctttccaataagacagtgcaaaaagcacaagcagcagcatttgaaatgtacagagaggaagaatatcttccagagtctgttcggaagtattatgatcttgaaccggtagataaagcgctaaaagaagtccattttcctacaggaacagaaaatctaatggaggcgaagaaaagaattatttttgatgaattctttcgctttttcagtgcgttagaacttgtaaaagacagggaagagcaagcactcaatcattatattatccctatggaagaaccggtgaaaagatttatagaaagcctgccatatccgctcaccggagcacagaaaaaagtattgagtgaaatacgtcaggatttttccggaacgatggcaatgaaccgtcttttacagggagatgttggttctggaaagacaatcgtggctatgacggcaatgtatgcagcagtactttccggttatcaggcggcgctgatggctccgacagaagtactggcacagcagcattatcagaactttaggaatcttttgtcaccgcttgggatttctattgcgctgcttaccggttctacaaaaggcagagaaaaaagagaaataaaagaaaaatgtgcttccggtgagattcagattttaattggaacacacgcagtgattcaggacgatgtactatttgataatcttgcattcattgtcacagatgaacagcatcgttttggtgtcaagcaaagagatgcatttatgaaaaagggaagagatccgcatgttcttgtcatgagcgcaacgccgatcccgcgtactttgggaattattctataccgggatttagatgttagtattatgaacgaaatgccggcatcaaggctgccaattaaaaattctgtcgtgggaacatcctatcgaccggcggcatgggaatttatcagaaaacaggtggcacttgggcatcaggcctatgtcatttgtcctatgattgaagaaagtgaaaaaatggaccttgaaaatgtggaagagtatgcacgtatgctttcgcaggcactacctccttccattgcggttgccgctctaaacggtcatatgcgatcaacggaaaagaatgagattatggaacgtttctcgaaaaatgaaattcaggtattggtttcaactaccgtagtagaggtaggggttgacgttccgaatgcaacggtgatggtgatcgagaatgcagaacgctttggccttgcacagctccatcagcttcgtgggcgggtaggaagaggaaaagcacaatcatactgcgtatttatttccggttcagaaaaagaagaggcaatggaaagactttcgattatcggccattcaaatgatgggtttgaaattgctaacgaagatttaaaacttcgtggtcccggagaattttttggtgtcaagcaaagcggaacgatgaactttgctctaggagacatttattccaatgcagatattttaaaaatggcatcggaagcggtagattatctgaaaaaagaaggctataattttcagaaactacaccaatactcgctggagaaaaatttgaattttgcaaagaatatttaaacttgaaaatcagccacaaaagcaagggagggaaaaactccgagagtagataaaagaatgggagagaaattatacttatgaaaagaaatccaaatttgaattatgcctgccttccaatggaaaatgcatataatgtaagggagctgggaggctatgcgacaaaaaaaggatcggttacaaaccaccatcaatttcttcgcagtgagaatcttacagatattacggaagaagataaaacatttctgatagaatatggcctgtcagcgattattgacttacgaagcagagaagaagcacttatttacccaaatccatttcgggggaatgcggcagtaaactatatgaattgcccattgatcacagaggatgtactggatttaagggcagtaaaggaaaaaggattcgaccccggagctttttatataaagctggtagaatataaagaaatgatctgcaggatttttcattttattttagataacctggacggatgtattttatttcattgtcaggcgggaaaagacagaaccggagtacttgcaatgattcttatgggacttgccggagcatcaaaagaagatattattgcaaattatgaagtgacacatacctatctgaaagaaaatgtaaagcttcgtcttgatgatggacttgaagaacttgagttttccagaccggagtggattgaaaatgcatatgatcacattctagaacattatggttcttttaaagtttatcttatggcagcgggacttacgaaaaaggaaatcaagaaagtccggaaaaaattaggcaattaagcataaaatacctttcgttcggtatgagtgaaaaggtttacctcagtcgagaagactcccacctctttcaagtggtgagtgactgctcgacttgaatgcccttgaaaaaggacagaagatattatacaataaatacaattataacaagaaaaaggatggacagaagatattatgagagttatcgcaggttcagcacgccatttaaagttaaagacgattgaaggaatgggcactcggccgacaacagatcgaatcaaagaaactttatttaatatgctgtctttttatgtggaagacagtcggtttcttgacttatttagcggaagtggcgggattggaatagaagcgttgagcagaggagctaagcagtcggtttttgtggaacagaacaaaaaagctgtagcttgtattaaagagaatcttacgcatacacatcttagcgataaggcggttgtgatgtctaaagatgttatgacagcactgcgcttattagatgatgaaaagcagacatttgactatatatttatggaccctccctatgggaagcttttagaaaaagaagcagtactttaccttgatgattcttcactttgtgatgaagataccaccattatcattgagtcagatctggatacagatttttcatgggtaatggataccggtttttggattacgagagaaaagatttataagacgaataaacatatttttcttcagaaaaaataagaaagagaatcgaaggaaacacgaaaagaaataataaaagaaagaataaaagaagaggacagataaagttatggcaacagcagtttacccaggaagttttgatccgatcaccctgggacatctagacattataaagcgtacagcagcagtttttgataaagtaattatcggagtgttaattaataagtcaaagcagcctttattttctatagaagagagggttgatttgataaaagaagtaacaaaagatattccgaacgtggagatcttatcttttaatggacttctgatagattttagtgatagaatgaaagcagatgttattgtcagaggaatccgggcagtatcagactttgagtatgaactaatgatggcacagacgaacaagcagttaaaagcgaatatagaaaccatgttttttgctaccagtgcagaatattcttttgtcagttcgagtatgataagagaactggcagctttcggtggtgatattacacagtttgttccggaagaggtcagcaagagagtgtatgagaagtttaaacaggtttaatgtattggtattttgatattaaggtggacctatcgtgatatcaggtgcataaagcatagttatgggaggatattagaatggcggatatggatagcgcaaagttacttgaagaaattgaaatatacatagataattgtaaaacagcaggtgtgttaagcagcggaaatatgatcaaggtgaatcgtgaagagctgatcgcaatgcttgaagaagtgagaatgcgtctgccaaaggaaatcgcagagagtaagcgcatcgttaagacaaaggacagcattattgcagatgcaagagcaaaaggacagcgaatcatgcaggatgcggcaaaagaagccggtgtgatgatcgatgatcaggaaatcgtttccatggcaaatatgcgggcggactccattgtatcagaagcacagaaagaagccgatgaattaaacggcagagcaagagaggcagcaagagaagtacagacaggagctttaaagtatacacagaatatgttagaaggtctggagtatatgtacagtacgatcattaaagaggaaaaagagtactttaattctgtacttgaaaagttaaaagaaggacataagcagatcgttgccgataaacaggaaatcgatatgcagttaaatgccggtatacgtacaggaagacgaaaagaagactttgaaaagaaagaagaaccggcagaagaataagattataagcaggtatcctgtgtggcttagcggaatctgcggtaaaacagtatcagatcagaatagaacatagcaggccggaagaaagagcagttactatttttattgctgcatattttttcaaagacagatcggtatctgcgatcactgtctgtacctgcgccatagtacatagccctcccaaagaggcggccattgcgctgagggcatacattgcttttaaagaatatatgttacttacagctaaaaggtggattcctgtcgtgatttcaagattagctaaaagaaaagtgcagataggcgtacgaaacagagaaagccgcataagcattccagaaagaatcgaaaagatcattatgtaaataccgataatgctgataatttttatcgaaggaagccagacatcatcagacaaagaagcttttttagagccagaacgcttcattggtgagaggctgttttttgctaaggtttgaatcgtttgtttttttctgtgattattttgatgcctgtcaaaacactgtatccccacataacatagaaaaacaggaagatagagtgacaaaaagtaacaaagccatgcccttccctgcaggttgatctgtgagcggagataccccattataaacatagggtttagaaaagaagcaagcgggagcagacattccgcttgctttttgcttaaagttttactctggtagtaataagagataaagattgccccaattgggaatccggaacataaaccaagcaggaaaacaggcagggatatggcaataccggtactgtcagaaaagattttttgtgcctgccggaaaaataattccggtattttgtatcgaatccagaatttcgataagataataaaaggcagaagcagaggaagcacattagaagcccagacagaaattccgtcttttgcataacttgatacaagagaatattgtgccagcatcgctataaagaagagaaaacagagtatttgaacaaagcgaaagcagagttttttcaacgcatttctccgaaatgttgttatgctaaaatatatgcggaatatgtgaaaatatttcttgacaaagaaaaagtaaatgtgtataataccaagagtatgagaaaagagaggttgcgatattatgaagataaatatatcggaaatcttatctaatccatctgttatcaagaattttaaagttgaacctgattttgagaaacttaagcttcgcagaagcagttatcgggtatcctataaggagccttttcttttgactgtctccaaggtcgaggataaacttcatgttacaggtgagacgacgattcgattgataataccatgtgatcgatgtttggaggatgtggagaatacattccatatcacgattgatcgcagtgttaatcccaatacagagtcagatggcattgaagacgtggatgaacttagtttcatagacggatatatgttggatgtagacaagctcattatagatgagattgtggttgcactccctaccaaagttctttgtaaggaagattgtaaaggattgtgcagcgtctgcggtaccaacttaaactatcacagttgtgattgtcataaggagagtctggacccgcggatggcggctattcaggatatcttccgcgactttaatcgttagatattaaagtattgaatactgcataagaaatatatccgaacgtcacaaaaagaagtaattataagaggaggtgtgaccatgtcaatttgtccaaagaataaatcttctaaaggaagaagagaccgccgtagagcaaactggaagatgactgctcctacattagtaaaatgtagcaagtgtggtgcgttaactatgccacatagagtatgcaaagcatgcggatcttacaataaaaaagaaatcgtttctgttgactaattgttgacgaacaataagctgtgaagcggttttaaaaaggcaatattgcatgatagatagggatattaagttatccctatttttttgtttaaaaaaacaaaaaggttcttgcgaaaacttcagagaagattctaaaggtttaattttgtataagaaagaatatccaattgaaataggtaagattatgtgagataagtatgaaaaaggattcatacgttcaaaaaatgattttgaggagacattaaaaaatgtgttatctgattgcgaaagatagggaatctcatggttgtcttgcttttaagacaacacatggtaagcatcttgtagaactaaaacgaaaattgaatagagcggtaggttataaaggagtacaacttgttacgattagcaggccaacagcttatggagaatacgctccatatcaatttgttgatacagaacaggaatttgaaaaaagcgttaaagcgttgcgcccgtagaattcttttagtaaattgcaaaaaaaagttatccatcttgtcacaatatttaaaattcaatcccggcgggcattacagcctgctgggatttttgctttgtaacgatagaagagctggggtatcaattttgaaaaaactatcatgataaaaaaataacaatatatcaaaaagagagagcgcatcgggaaagaaaaatacaaaaaaagtacagtatacaacgttttttaagaaaaataaaatttattcaaaaaaatcttgactcacatatactgttatgatattataatatccgttgcacacgagaaacccatttttcttaggaaaatgaaaagaatcttaaaagaaagtaaaaaacttcttgacagattaaaagttgtgtgataacatataaaagttcacatttgacagagaaaacggacttcttaaaaaagaagaaaaagttcttgaaaaaagttcttgacaagaacttgaaaatgtgataatataattaagcgttttcgaaaggaaacacaaaaccttgataactgaataacaaaacaaccttgaacgttaattcaaatttcattcgggttttcctgagagtgatgtctgcagg

SEQ ID NO: 437 - DNA, 29049 bp, Eubacterium hallii
tgctgaaaatgtgtacaaaaagtccgtcgcagttacggtcgttagaccgttactgcgacggaacctttggctgcaaataaaatccgtattttctatgctgcgataatctttactgatacgctacgctatatcagatgtgagatgacgcgcatctcgcaacaagaatgccggggcattcttgaattagacaaacgattattttgttacgattttgataaatttcttctttcctctctttaacacttttccttcaccgctgaagtcgtctaatgtataagaagctttaaagtctgttactttttctccgtctaatgttacaccaccctgtgttacattacgtcttgcctcagaacgtgttcctgctaaaccggattttacaagaagtgcgagaatatctactgcaccgtctcttaagtcttcttctgaaacttcacatgttggcatgtttgcagaatctccgccattgctgaataatgctcttgcagcttcctgtgctttctgtgcttcttcttcaccatgaactaactttgtaagctcaaatgcaagaatttcttttgcttcatttaacttgctaccttcccagctatccattgcatcaatttcttctaacggaaggaaagtcagcatacggatacacttcataacgtctgcatccgcaacatttctccagtactgatagaagtcgaatggagaagtcttattaggatctaaccatacggcaccggactgtgttttacccattttctttccttcggaatttaaaagaagggtaattgtcatagcataagcatcggcatccggtcctaatttacgacgaatcagttctgttccgccaagcatgttgctccactgatcattaccaccaaactgcatattgcagccgtatttctggtataactcatagaagtcatagctctgcatgatcatgtagttgaattctaagaaggataaacctttttccattctctgtttgtaacactctgcacgaagcatgttattaacggagaaacaagcgccaacttcacgaagtaactcaacataatttaagtctaacagccagtccgcattattaacaagcatagcctttccgtcagaaaagtcaataaagcggctcatctgtttcttaaagcactctacgttatggttgattgtctcttttgtcatcatctgacgcatatctgtacgtccggatgggtcaccgatcatagcagtacctccaccaattaaagcaatcggcttatttcctgccatctgaagacgtttcatcagacaaagagccatgaaatgtcctacgtgaagactgtctgctgttgggtcaaatccaatataaaatacagcctttccattgtttacaagttccttaatttcgtcttcatctgttacctgtgcaatcaatcctcttgcaaccagttcgtcatatactgtcataaaaacctccatttatttttcttattttatttaacagggtatcccaacggaattctccaatgaaactccctgtaaagtaaaaaaatcccgtcctaataaaaggacgagatataacttcgtggtaccaccttttttcgcaaaacaaaatgttctgcctcatagacaagcgtcaatcaacgcttctgcggataacggccgctgctccgtcacagcctactaaaaacatcggtctcattcggtgtgcaactcaggaatgtattcacttactatctagcacatgacctcccaccagccggtcactctctggaatgcatcaataaaagttacttctttccgtcttcgtctttcgctgaaattcatataaatgatgtccgttatatgcggacaggcattatgtctcctattgtagtaaaccttcaaaattttgtcaagtaggattttggaattcttgaaaaaaggaataaaaagaatgaaaagaacaaagaatgtgccttggcacattctcgcgcctgcggcggtcgcttgcgacatctaccttatccgccgcagtgcgcatcctcgcggagcgttttttactttgcaggaaagcaatttcctgtaaagtaaaaaaagaactggtcaattgccagttcttaaagagaggaaagtatgaaaaaatctatcaaaaaagcgttgttgtttttttgatgtctctatcataccgggaaattgtgaacagtctgtgagaaaaaaatgaagataatctgaagaatcgctatttaatccttatcattttctttcgtttgtaaacaaccggttaaaattagacctgataaagtaaaatatagcctcctgtattcttctttctgctaaaatataaatgcgtatcctctgtatttttctgcggaaacatataggatatcagttcggaaaggtctgctctttttaatctttgtacttctcctgcccattcccttgttgcagaatctgtaaaaactacctgtccttcttcatcaactccaagaagaatcattgtatgataagaacccgcatattttttatcaaaaaagcgaacgatttttctgccttttcttctcattctacttgtttctataataacaggactgcctttttgtaaatgttccataatctgctttttggcatagttatcctcaaagtttcctacgtattcacaggaaattccttcttttttcaaaattactgaaataccataaagagataccggcatctgccttgccatcacttttccgtaatttttttcataaacttcttttggaaaatgttttttctcgatttcgcaaatggtttgatccggtgttaattttgcatacttttccacaaaagctgccaatgcggttgtcagtgaacagcaggcacacccatggcgaaggatatattcactggcctccccataaacccctgctttttgctgaaaaaccggataaactctttttgtactgccatcagaaattattactttaagtatttttccattcagatcactgttcggaagggatggagaaagaaacttctttcctttattatctgtcaaaaagttcaaatgtatacactccataaaaatcctttctttttcctgtttattatttcctgcttactgtttcctgtttttctttcgttttcttcatgccgccttcgtaaaatctctccatctgcacttttgttcaaatggagagattctggcacttttttaaactaaagttttgctattatctttctcttatacgctaaaaactgatctgtaagataaaaatcttctgctcgtggttttttttcctttatcacgatctcatcacgtatttcccctggctttccattcaggatgtaaattctgtcagagagcaaaattgcctcatctatatcatgcgtgataaaaattgtagacagatcaatatgctgcataacttcaagataccatttatgaattgctgtttttgttatagtatcaagtgcgctgaacggttcatcaagaagggctactccattggaagaaagatatgttctaagaagagctgccctctgacgcatgccgccggaaagctgagaaggatactgatattctgtcccttctaagccaaaatctttaaaatacgtctgcgccttttctctcgcttcttttttcttcattccacgaagtacgagtggaagcgctgcattatcaattatttttttatgtggaaaaagtaaatctttctgaagcatataactgatctgacctggtttggatgtgatatcttctccattaaggaatacttttccttcttctggcgttgttaatccggaaagcacatggaaaagtgttgtctttccagaaccactgaccccgagaagagagactaattctccctgattcagttcaatattaatatctttgattatagttcttccactatatttctttgtaatatgttctgcttttaaaagacacatttatccatttcctttcataaacaaatcattatccaaaaaattacttagaagatggaagatactcgttagaaaatccttttcctgtaagatcttttgttgtcagcttattctgtgcaagccatgtgtagaaattattccatcttgtctcgtcgatcacaccccagttgtctgcatctgcaacatactgtttagaaagccactcctgacttttatatactaaatcttcagaaccttttaaagagcctgtatcatcgccttcaataagaatatctgccgctttctttggattatctattgcatactgatatcctttttctgttgctgcaagaaaagctttggcttcatctggtgaatctttcaggaaatcattatttgcgatcataaccggtgtatagtaatcaaataccggatcaatatctttgaaattccagtaatcacagtcaacaccttctactgtcgcattgattccgccccatccatagaacacccagattgcatctgtctgttttgcttttaatgcagccggttcatctgtaatgttgttaggaatcagttttaccttactgaaatccgctccttcatctttcataactgtttttaaagttgcctgctcaattggggattcccatgtagaatatgtctttccttcaagtccttttggactgtcaatgccgtcgccctttctggaaataattcctgatgtattatgctggatcaatcctgcaactgctgtaatcccaagtggattatctgaatcaattgctgctgccattgtatcctgtgcctcaatagcaaactgtgcctgtcctgatgcacacatagttgctgccccattttccggtggctgcacaatctctacatcaagtccggcatcttcataatagccgagtgcttttgctgcgtaaattcctgtatggtttgtatttggcgtccagtcaagacaaaatgttatctttgtaagattctttttgttattttctgtacttgcactttcattctttccgttagcagaaccgcatgctgttaccgataataacataactgcacttaaagttcctgcaatgactttcttccagtttaactttctcataatttcctcctgtatatacttttcttatacttcttactattcagcttcctttttttctactcttaaccatggaagtgaaatcgtcttaatcagattcactacaaacattaaaagaaggctaatgatcacaataaaaataataactgcaaacattttatcaaaggcatatgcttttgacactcttgtcatgtaaacaccaagtccttcaaaaccgccaagccattcagaaataactgcccctactactgcataggaagcagaaatcttcaatcctgagaaaaactgtggtaatgcggccggtaacttcacatggaaaaagatctgcacttttgatgcacccattgcccgcatcaaatcaatagaatctttatctacactcttatatccgtcaagtaatcctaccgtaataggaaaaaatgttgtaatcacgacaagcgtaatcttcggtgccatataaaatcccatccataacacgaggagaggggcaattgcaatcgttggaatggtctgtgtaatgatcataataggatacaacgctttattcagtatccgaaaatgatccattaatgttgccataacaaatgccagtacaacaccgatacataatccgtaaaaggcttcctgtaatgtaacaactgcatgtcttaaaattgtaggcaaatctgtaaaaagtgcttttactacctggaccggagacggcagcatatacgccggaactgccccgctctgatataaaaactgccagagaagaattaacagacagagtgctgctgctgccggaagcttactggtgatgctttgtaacctttttgtcaatagtcagcacatctccttccgctttataagagatcttaacataggtattcattgccttgcagcctgccttagcagctactaactgacaattcttcacgatttccatgagtgtatcataatctccttcgattgatgtctcacatggtcctacataataatttaatccggttgatttaatatagtcaattacctcgtctacaatacgaattacttcctcttcgtcctgcacagatggcaaaacctgaattgctacacttgcgttcatttttcattcctccatatatctttaaatatcatgtgctgccttacctgaaaaaagaaaagcgccggcaataaatgctgacgctgcttttgtatgatcctcaggtattcttaaaactttataaaaaatttatattaaaagttctccaaaaaacatcctgatacattctgttattaaaagctcttttacaacttcttccacgctggcattatccaaacaggtacaagggtctaaggtttaccttactctcagcttcttaaaatcacaagctcccctggtcttatattgaactttttacagtataaaacaattttaagaaaaaaacaagggcaaaactcttgcgttaattaacaaaataatggtataattttgctttagtaaattaaagggggactgtactaatgctaaaaacaatagaagccgttaacaatgttgttaacaactttatctggggaatccctgccatgatctgcatcattggtgtcggccttttcctcagtttccgaacaagattcattcagattcgaaagtttccttattctatcaaaaatacactgggacgaatttttgataagtctgaagccgcagatggatcgatcaccccgttccaggctgtttgtaccgcacttgccggaacagtaggaaccggtaatattgccggagtagccggtgcaattacgataggaggacccggcgctgttttctggatgtggatatcagcccttcttggaatgtgtaccaaatattctgaagtaacacttgccgttcattttcgtgaaaagaattctcagggtgactgggtaggaggaccgatgtattatattaaaaatggtctttccaaacactggcactggctggcgtttctcttttccctcttcggtgtcctcactgtatttggaacaggaaatgcaacacaggtcaacacgatcgtcgctgcgattgattccctgatgctcaactttaaccttgcttcatcagaaagcctttctacaatcaatcttgtaatcggcatcatcatcgccatcggtgttggactgattcttatcggcggtatccgccgaatcggaaaggtaacagaaactttagttccatttatggcattgctttacctcatccttggacttggcgttgttcttttaaatattcagcatgtaccggcagtatttcggtccatttttgaaggagctttccatccggcagcatttagcggcggaatggttggatcattatttaccagtatgaaaaaaggtgtatctcgtggtatcttctccaatgaagcaggtcttggtaccggatctatcgctcatgcaacagccgatatcactcatcctgtaaaacagggtctgtttggtatttttgaagtatttgctgatacgattgttatctgtacactgaccgcattgatcattttatgcagcggaatcaacattccttacggctcagccgccggcgcagaactgactattcagggatttacctcaacttacggtggatgggtatccatcttcacagccattgcactttgctgctttgcattctccaccacgatcggctggggactttacggctctcgctgtatcgaatttctttttggaacaaaaacgattcacccatttatgatcgtctactctctcgttgcgatcatcggtgcaacggtagaccttggattattatggagtatcgcagaaacatttaacggacttatgtctattccaaacttaattgctgtattcctgttatcgggaactgtagtgaaattaacaaaagaatatttcaataaagattccgatttgtaaagctaaacaaacgaaaagtagaaattttatatagaagaaaatgtaaagatagtcacggcatagaaaatgcctaactggcatttttatttgctccgacatcacattttcttctatataaaatttctacttttctgtttcttatcttcaaatgaaatcaatatcttcatttagaggaacggaagggggctctccagaaggttatgactttccggggaattgaattctaaaagactgactgctcgtattttagttccatactttgttttaatttactgaaacatcttctgtttgacttaactgtttatgaacatcacgtccaccatacataattcgcactacatatactatttcagttttatcatctgttttgtaaaataccaaataattatccactggaaaaaatcgaagtcctctactgtgccacggttcttcttcataaaaccgatttctgctcggcatggtatccagctttcgaacagcggtcataatccgatctgtctgtcctacagcattctccggagccaacaattcctctgaaatatatctgaaaatattttgcagatctttctttgcccctgctgtatacatcactttatatttcatataccaaattcctgtttcatttctgcttcaatttcatctgccgaatatactctgccagccttaatatcttccatgcctttctctatttctgcattgaattgttcctttgtcaaagaaccatatacaacaggctcttcataagctggaagtttcatctcaaaaggaattcctctctggagtacaatctgtctcagaaacatccctactgcattggacattggaattcccagtcgatcaagcacctgttctgcctgttcttttacttcaggttcgacacgtgcaaatacatttgctgttcttgccatagatatcgcctcctctttttttcattatatcttgtttgattgcaagttgcaagcaattcgcaatctattttcataatttcatacactgacagacggcagatgcagataaggtatttattaaaatcctgattagcaggggggcgccaaacgcttcattttacctcaaaaaacgaaaacttcggaaaaatccccattctcaccaactgtggatttgaagtaatcagaaaaaagaaaaaataccatattccagatgcggcttgggagcgtgtttaagatgcggatgagcatcttaaatacagcgactacagagcagatgggatatggtattttttcttttttcgtctatattaaatctacaaattagatttattcttctaattcttttttgcggtttcttgcataatgacgtatcatctcaaaatcctgtctattcttccaagtaattgtttttaaaattgctccagaaaacagggatagaattgctgtaagaataacaaaacaacatacgatcagggtagggaaacgttttactaaacctgttgcaaaatattctttaaaaactggtattgaaaatccaccgcccaatactgctaatactgctgaaatcaacccgaaatatttcattggctgataggtacggaataatcgtgcaattgttcgaagtacttttattccatctgaataagtatttaacttgctctcgcttccttctggtctgtctttgtaatcaacaattacattctctacaaacatattcttatctgcggcatgaatactcatttccgtttcaatttcaaatcctcttgagattacagggaatgtctttacaaattcataactgaaggcacgatatccggtcatgatatctttaatatctgtgtggaacagatgattaatggagcttcttactaatgaattaccaaagttatgaaatggtcgtttattctcctgaaaataagttgaggataatctatcaccaactaccatatctacatttcggtttaagaccttgtctaccatctctggtgcattcactgctggatatgtatcatctccatctgtcataatataacattccgcatcaatatctcggaacatacgacgaattacatttcctttgccctgttgatactcataacgtaccacagccccattctgacgtgcgatctcatccgtaccatctgtagaattattatcatacacgtaaattgttgcatccggtaatactgctttaaaatccttaatcactttttcaattgttttgctctcattataacaaggtataagaactgctactttatccataatatcctattgtcctctttttcttcttcctcatgtttcgtaggtcccaaagtcacacgccttttcgtgcaagcacaataaggcgtgtgactttgggaccctatatcatgatatgctatatgatgtcacgaattactctgcagctaacgctactcccgtaattctgattatactttattaatgtatcatcgtcaattctggtcaataattcttaagagtatttttcagcaaattattcaagaatgccccggcaaactcagaaattgataaattagaatttaaataccgctactccatatgctggcaatttatattggatagagtactttcttccatcgcattcttttttcactggcttatattctttcggtcgtctctttccttttccgccgaacttcttatcatcactgttcagtacaagagtatgttttctgcggcacgttgttcctacccggtaatccggacgttctaccggtgtaaagttaataacaaaaagcatgttattctttccacttgcagaatgtcttacaaaggagaaaatacttctgtcaccatcatccgcattgatccattcaaagccttccggccagcaatcatattcataaagacatttattacttttatataggtgaagtaattcttttacaaataactgaagctgatgattcggctctttctctagaaggaaccaatcaagttccctctcttcactccattcccgatgctgtccgaagtcctgtcccatgaaaagaagcttcttacctggatgtcctgtcatgaatgcatagcctgccataagatttttaaatttctcttcatagcttcctggcattttttctatcatagaacattttaaatgaacgacttcatcatgagaaagaacaagcatatagttctctgaatatgcatagaccatggcaaaattcatcttagtatgattatattttctaaaatatggatcaagtttcatatactctaagaagtcatgcatccaacccatattccacttaaggctaaaatccaagcctccatactctgccttatccgttacttttggccatgcggtagattcttctgcaatcataacgattccaggatttctcttctttacgatcgtattcagatgtttaaagaattcgattgcttcaagattttcatttccaccataaatattcggaacccactgaccatcttctcgtccatagtcaagataaagcattgaggcaactgcatctacacgaagtccgtctacatgatacttttccaaccaaaacagggcattacaaatgaggaagttccggacttctgtcttcccataatcaaatactttcgttccccagtccggatgttcaccctttcttgggtcagcatattcataaagacaggttccatcaaattcagctaagccgaaagcatctcttgggaaatgtgccggtacccagtcaagaataacaccaatattctgttggtgaagataattgatgaaatactgaaaatcttccggagaaccatgtcgtgaagttggcgcaaagtaattcgtcacctgatatccccaggaaccatcaaatggatgctcggcaatacccattaactcaacatgagtatatcccatatctttcacgtattttgccagctcatgagccatctctctgtaattataaaatccatctacatcttcttctgtttgttcatgctttttccaggaacccggatgtacttcgtatacaaacataggatctttcttatcatcgaacttctctctcttcttcatccaccggctatcctgccatttaaaatcggaaatatcagcaataacagatgcattattcggacggagttctgcctgaaatccataagggtctgcctttagtatcgtatagcccgcctttgttgtaacacaatatttataaatatctccaatcttcatttcaggaagaaagatttcataaattcccaatggctctaaacgttccatcggtgtagcattctcatcccattcattaaaattgccaaccagggaaactgcttctgcattcggtgcccatacagcaaaatatactccctcttcaccatcaactgtcataggatgtgctccaagtttattatataaatcataatgtgtcccctgaccaaataagtactggtcaaattctgtaataaatctggtatctggcataacagactcctcccgtttcaaaattcacaattttcttgttcattatatcataaaatagtagttttttcagcaattacttatgcattttgcaaataggatttccataattctaattatttgaaaaaaaggataacgaatgtacctcgacacatttcccaggaatttctttcctgtaaagcaaaaaacaggagaaagaaatgtcttctcatctctttctcctgtataaatatgtctcttatatacaactatagaaccattttatttattttagaatattaacattcgccatgtttacagattgtcttgatccatccttctggtgcttcaatatgtcccatctggattcctgtaagcgtatcatataacttcttgattacaggtcccatatcatccattccgcttgggaaacagatttcttttccatgatcaacaatctttccaactggagaaattactgctgctgttccgcaaagaccacactctgcaaaatcttttacctcatcaaacagaacttctctgtgttctacttccattccaagataatgttctgcgatatacatcagagaacgacgggtaatagatggaagaatactgtctgacttcggtgttacaagcttaccgtcctttgtaatgaaaataaagttcgctccaccagtctcctcaacctttgttcttgtggctggatcaagatacatattctcatcatatccctgattatgtgcgtctacgattgcatgtaaactcatcgcataattcagtcctgctttgatatgtcctgttccatgaggagctgcacgatcaaaatctgaaactctgattgtaataggctttgctccacctttaaagtatggtcctactggagtaacaaaaatacggaactgatactcatccgctggttttacaccaataaccggattagaaccaaacatatatggacgaatatataaagtagctcctgaaccgtaaggtgctacatatgctgcattcgcttttactgtttctacaacagcttcaacaaatttttcttcagggaataccggcatctccagtcttctacaggaatctgccatacgggctgcgtttaagtcaggacgaaaacaaacgatatctccgctctctgtcgtatatgcctttaaaccttcaaaacatgtctgtgcatactgaaatacaccggcacactcgttcagagtaattgtagcatcttctgtaagggcaccttcatcccatgcaccatccttaaaattagctacaaatcttttctctgtctgctgatagctaaagcccagctcgccccagttaatatctttcttttccatcgcgaaaacttcccttcttaaaatatgaaataaatctaaatatgaaataaatattataaaaaacttcatttcatgttcttataaattttgaagctattataacacatcatttttcaattttctatgaaatcacagaaataaatctaaaaaatttatgatgttcccatcatttcatgattttgcacaaaaaaatgtattcttcttatttatttatccatatctttccagctcttttcatataatgacagagaaacaaaacgaataaaaaagaaagaatgattcattataccttcaaatcaattctcatttattacatttaaaatcagcaggctctcctcttccattcaagtcgagcagctgtcactcaccacctgaaagaggtgggagtcttctcgactgagataaattaaagtgccaattctttcatccataatccggcgagcattttcattccttctttatttggatgtactccatctacagtttcgtattctttctgatacttttctaaatctgccagatgcacttctgccttttgtacacagtctcgtataatatcagaataaattctctttgatatcgttccatcgatattaaagaacacttctccttccggctcttttccctccggaagggtgcagcaccatatctgtgcatatggatatgtgttcttcaatctgcaaagcattgtctggtatgccgattcaaattcttccggcaatacgcaaaatccccagtcattacaacctgcactcacaagaatgaggtccggtaatccattctctcctaaagcctgaattctttcttctgccatggcagatgtagataaattacccgataccatactgcctgccaccgaattattaatgccaagctctgcatcaaatgcacgaatcacctgcatccaccatgtatcttctactgttttaactcctgtctcccactgcacataagaatcatagaaaacactgtcttttggtgtatagccagcgaatgtactgatagaatctccgagaatagatattctcagcttcctttctttttgtaataccttttccataaaatgtaacctctcgacgaactctgcctgccagtaaaatcttactcctttgcatcaaatgcaacaccaacaacacgaggtcctgcattcgctgctatttctgctccaatctgataatagctacttggaccgtagccaagcttctctgtcatcttctgcgccatctcttccttaatcttatcatcatccccgtattcgatctgatatgcagaacccggttccatgtctgcaattgccatatcgcagattttagatacaactttcttctctccccgacactttccggcagttgtgatctcatgatcccaaatcttcatgatcggcttaattccaattttatctccgataaatgccgctgcactcggaatacgtccggactttcctgcatatttcagattataaattccaaaataaatacgtctgtgagcaatcttttcctcaagatacgcattaatttcttcgacagagcttccttcctgtgccatctttcctgccataactgcaagttcaccatatccggcactataacttccaccatcatggctgtaaatatgcatcttaccttcacattccggatgttcttcaatcagcatatccactgccatcaatgagttattatatgtcgctgatccctttccattaatcaaaattaatacaagttctgtgcatcccttctgataatactcataatataaatccataaactgaaaggctgtaatctgagaagtcattggtattccatcattctcctccatcagcttataacatccttcattatcaaaatctacacgacttgtatatgtctgatctcctatcacaacagaataggagatcacatctaaattatatttctgttctgcttcctttgagatatcacttgcagaatccgtaatgatctgtatctttcccataaaaacttttcaatcccttccaaaataaatagtattatttttcacttactctcaacgaattattcttaacgaatttattataaacaagcttcggaatcctgtcaacttgatgctatccccacctttccaacaaaattagaacggtggggatttaaagggatggaaaagtttataattagtgatcgcacagctacacattactttgttttcacagactttatctttgaccatttagaataatatgtcttgccattgatctttaaaattgtgcggacacgtatataatatttcttctttgcttttaatttttttaatgtaacacgagtttttttgtatccattcacattttttgtttttgcttttttaaagcttctctttgtactatactgaatctgataacctttgattctctttttctgcactttggaagttattttcttccatgtcaaagcaatcgatctttttgctgcttttacagagccgagttttgttgcttccggtgtcggaactgctgtttttttcgctgctatcgtaactttaagaattgctgtagaggcaagttgtcgatttgtcatatatgccatcggcgcagatgctgtcgcataacaattctcatcaatcacatattccaggtagactgttcctggattatgtgcattcaatgttacttttccagaacggctttggctcaaactcgctatgttcccggaaacatcttcttttccatctgcagaagttataatccagtgtcccttgtcctgattaaatccaatataatccgtacctgctttattaattcctttgactctaatattggatatggtaagagaattaccaatcaaaagattcaaatccgatgctgtcgtttcaatttttgacaatggctgcgttgaaatcagtccatcatatgtaacgttgatcgtctttaaatttacactgtatgtagctcctgcagaagacattggaatatacaatgccgtattggattttgcatactgaaatgcatttttagtatcagaatttgattgcagttcactccacgtaatattacggttagtatctttaatatttatattatcggtaaggtatacttttaaatcttcacgtgcactgatactgtcacttccaaaaacacctaatgttgccgtatctgcaccagcttcatcattactggcatttaatatatgttctaataacataactttataagtaaggagtacagggcaattatacgttgtaacttcctcactgtcagaagtcgtcctcttcatcataatcgcactgtatgccaggagagaaattgacgatttatcttctttccgctctgttttgcttacggactcttcctttgaccatcctttttccactgtattagaataatcaaatgtataatcaatcgaaccacttgcgaatgctccaaaattaacatttgtgccgactgttacagaatgtcccattgtataggaagaacttccattaatattactggtatgtgaaaccgtattttcagtactgccggtatattctgcattaacattctgcggtgaattatttgtaatacttgaaacaaaagagtctttacgatcactgccatcatttctctgcctgatataagttgttcctttatcttcctgaagcacaggactaatcttgaaatcataaaaaacagcaatcagagcacttccatgaccgtttcttctcttgtcaccatctgttcgatttaaacttaaaacagaccagaagacatcgcggtttgtagtatctgtaagagcagaaaaactattcgtggcactttgagagcctgaattccagccttttttattactgctactagtatgttgtgccagataatagtcatacagctttttacgtatatctgtattggcaccgcttaaagaactgctgtaatttagaccactgcgatgaatgtaccagttataaccatttttatactcattattggatatcttattggtattattgtattctgcaattgtaacataccgcattgcttccattcgagagttgtaattactggttgacgactgttttcctcgtttttgatgaagcatatatgcaacagaaaaccaatcctccgctgccgttgccttcggcgcattctgtttcgttgatgcgttatttttttcatgaacaccatcaagcatttctctgtagaactttaatttacttgattcaaaagaagtgctgtttacattaaatgctgtcgcacttccactgcatacaccggttgcttcttttaaggataacgtggcaggaatggcagccggtgccgccgctcgtacataacctcctggtgcgatagcaccagccagaaaggaaacagtaagaacaaaagaaaggaaacctttcttccacaggactttcctcatttttttcataaacatcaaacctcctttagattaaaacaccttattatttctactttcattgtattaaatataaatgaaaaaaatagttgctgagagtcacttgtttttgttttcactgcatcaaaaaagaacttacaaaacaggctagtataaaaatgcaactacaaagcatttttatactagcctgttttataagttcgtctattgttattaattcaagtcgagcagccacgagacttggcgcgtgattctggtcagcgtaagctgacatattctttacagaattactgcgcatcctcgcggagcgtttatctcagtcgaagattggactcccactgagacaaatttgctgtcactcaccacctgaaagaggtgggagtcttctcgactgagataaaattattcttccgttacacatgccatagcaagacctgtagcaacggcattacgaggtccttcacaaccacgaatattaccgcgtccagctacaatatcataatccgccagcgcatctgttacaaagtttggaatctcaaaatccagtgcagatccgccaaccattactacgaactgaatgtctcttggattacctgtaggacttacctttgccagagaacgaatcgcatttcttacaaatactttcttcttggcatccatacgaacctgttttactttttccaacgattccactccgtctaatggcacgagctcgtcattctcttttacaaggacaacctttgcaaaaatagatggatctaatggtttatcaaagaactgaacggttccattctcatgacgaatatggaaaagactttctactttagcaagagtgtacttctttacatcttctgcaagttcgatcgtatccagaccaagttcagactgaattaacaaagaaaccatgtttccggcaccggccagatgaaccagttttaccttaccttctctgttgataatcgatgcatctgtagaaccagcacccatatcaacaattgccagtggaacacttgtaccaggagtagttaatgctcccttaattgccatgtctgcttcaacaccaccaacatatacaggaacttttaacttttcagtaagtacattcgcgatcatctccatctggagtctgtcagacttaaccatcgctgcaattcctacagcattctctaatgcaaactcgtctgcaatacctccaacaactttctgtggattaaatgtatctacagccagcaaatcctgaatcttaatatcttttggctctttattcgtaagacctgccataacacgacgaacattattcagcatattgccggcgttcgttcctgtctcaccctgaatatcatcaatatcctgaataacagatattgcttccataatcttatcggcaccctcgtcaacatccacatcgacttccttcttaagaccgataatattgatggttcctgccttaatacttctttcctttacatcacccgttggtgtcttaattactacaccggaacgtgctccgattaaagaacgtgcaatcggaacaactctctttgtctcctctgaattcaaatgaaatactgttgcaattccatatggattagacaatgtagataatatacttccctgctgtgccacttcgatcgcacaagtcattcccagcggaaccttctcgatcatggcaacttcatcaataataggaatcttcttatcaagacggttattaagtaatactccgtcatctgcctgtacgatcgcacctgtaatatttatattctcttttgcctgattcatcagtgttgctgcctgcgcaaaacctactttatcaggaacgatcacaataacatccttcgcctcttttatcttagaaagctctgttacaagaacagaagtaccaactccgattcctgtacctcccggagtacttggattatgtccgattactgttgactctgtaataactgtttcagaaatcgtctccatcgctacatctccaataacaggagcagcttcattaatacgaatctctgccagatcactgtaatccatgcctaccttttcaagagcattctttaaagacatgaaaactccgctgatattctgcaaagttcctttgattccggttgtaggtccgataccactcgccagaaatgttaaatctgtcccatcaatctttgcaagagcgacctcagtggtagcattacctatatctacacccgctacatacttcatatctcccatcctttcttccacccaaatcatctggcttgccggatatatttatcaggcggtttttgtaatcagccattgtgcatttgtaaaattacacaatattatgtataaattatatcactggcaaaaaaacgggtcaaatacaaccattacgaatttcttgatattattatgtaaaatttacaacaatttatgatattcggcatttctattggtaatattttgcttaatcctttcttttcttgccatttgtgaaaaatcaaaatactaatttgttggactaaagagacgaaaagcagaaatttaatatagaagaaaatgtgaagatagtcgcggcgtagaaaatgcctaaacggcatttttactggctccgacatcacattttcttctatattaaatttctgcttttctgctttttggctccagaaggaaattagtatttggattcaaggaagaataaggggactgcccagaaggctatggtttttatttgaaatgaaaatctccagaagagaaatctctttttactgaattatagttaatcttctaaagaaaaaaagaattgtgataagttagattttgttccgttgcgctaaacgcttcattttgcctcaaaaaacgaaaacttcggaaaaacgagtccgaagttttcagagtcaaaattccacagcgcaaagtcacaaaatgcaatacttatcacaattcttttttctttatcatagtcttcttacaattcagcataaaaatttgttttagcggctgacagtttaagaacaaataacaaattagtaatttgggttggaaagagaaggggggattcgccagaagattatgagagttaccagaggaaaattctccataaggtaggactagataaatataatttttatacaatcgagtaaaaaagtatcctcttctggggatgttcattctaataaaaaccatagaattctggacaagctccttattcccatcccaaatttaaatactaatttccaccaactgtggatttagtataatcagaaaaaagaaaaaataccatatcccagatgcggcttcgaagcgtgtttaagatgcgaacgagcattttaaacacagcgactacagagcagatgggatatggtattttttcttttttcgtctatacgaaatctacaaattaatattttataactattctactgtaacactctttgcaaggtttcttggcttatctacatcaagtcctcttgctacgcttacatagtatcccattaactgaagtgggatgatcgcgagagttgttgtgaaatgtggatctgtcttaggtacatatacaacaaagtccaccatgtcctcaaggtagtagcttccgttctctgcaacgcccatcagatatgctccacgactctttacttcctgcatgttgctcaaagtcttctcgcaaaggtggctctgagtaagaacaccgattacaagtgttccatcttcaatcaggctgatggttccgtgttttaactcacctgctgcgtaagcttcggaatgtacatagctgacttctttcatcttcaggcttccttcctggcagattgcgtaatcaagtccacgaccgataaagaatacatcatgtgcggatgcgaatttattggcgaaccactgaattcgttctttatctgttaagatacttgcaaccttttctggaaggagcacgatttctttgagcatattgcctaaggtagattcttcgatctcgcctcttacctgtgcagcgtacatggagaggatatacatacaaattaactgtgtactatatgccttcgtagtagcaacagcgatttctggtccagctaaagtatacataacgtgatctgcttctcttgcaatactggaaccaactacattaacgattgctaatgtctttactcccatttcttttgtaagacgcagtgctgcaaggctatctgctgtctctcctgactgtgaaataatgacaactaatgtatcttgggaaagctttggattacggtaacggaattcagaggcgaaatctacgtctaccattaatcctgtgaggtcttccatcacatatttggctgcgataccaacatgataagcagaaccgcaggctacgatacaaattctatgatactgtgcaaattcttctggtgaaataccgacagaacttaaatcaatcttaccgtcttttacatatgtattgattgtatctttgagtgcctttggctgctcatgaatctctttcatcatgaaatgctcgaaaccgcctttttccgctgcttctgcatcccacttaatgttaaccatttctttttcaatctcgtcaccgttcatgttaaagaaacggatgctgtcttcgtgaagttctgccatctccatgttatcaagatagtatacatttcttgtgtaagaaagaatagcaggaacgtcggatgcgataaatgctccaccttcattctgtccaacgattaatggactgtcttttcgtgctgcgtaaataacacctggacgatctttgaacataatacccagtgcgaaagacccacgaacacgaagtaatgctcttgacatactttctaatgggttatgatctgtcttctcatagtaataagcgataagcttcactgctacttctgtatctgtctcagaatagaaagtataacctttctgtgtgagatggtcttttaattcctgatagttctcaatgattccgttatgaaccataacaaccatcttgtcatcactacaatgaggatgcgcgttcttctcagaaggtgcgccatgtgttgcccaacgggtatgaccaataccacatccacctggcatcgcttttccgctgtctgttttctctaacagattcttaagacgtccctttgtctttacaatgtctatgtcattctcaacttcattgaaaacagctactccggctgaatcatatcccctgtactccagttttgataaaccattcagtacaattggcgctgccgcctctctaccagtgtatccaacaattccacacatatataatctcctttaaaagttaaaatgattgaaacaatttaaatttttcatccttaagtgtagcatggctatcgggaaaaggcaagcttttacgcgccaattcactttcctgattttttcggaaacagtttgttatttttattaggttagtatccggttttaatttattttcttctttgttctgtcggattgctacaattgttatatatgcaactattcagagtacttgcagtttgcccgtaatccctttttgataaatactgcttttctctgaatagttacttttctaatattaaaacttattccctctgcttatttttattccaaattacttaacatattacagactcacaacaactatataacttttacccgtttaaataaatcgagataaatgaatatttttcaaaattcttattttgcccaatatgaattaataattatattcccgtgtgtcccacggttgtgttatattgtataaaaactaagctaatttctcatattcagcaacaatcgcatctaacagcttttcatctgtaagctgagtgatttcttttgctgcttcacgaacgccctgctctttgatttttgcctgaagttcaacgctctgtttatcttctggattatcatagtgtaaagctgcaccaacaccaacaagtaagtggtctactggaagtccatatcctgctgctgttgttaatgggctgatcaggcggtctgttgggcttaatttacgaagtggctcacgacctacacggcttacatcgtcctgtaagtatgggtttttgaaacgtccgataatctttttgatgtatgctgcatgtttttcagggtcgaaaccatgtttcttgatgagtccgtcaccactctctttcattgctttagatacgatgtcatagatttcttcatcagcgattgctgcatcgattgttgggaatccacgaagctttccaagataagaagtgatgcagtgtcctgtatttaatgtgaataatttacgctcaatgtatgccattaagtcatctacaagagtcattcctttgatttctggaatctcgcccttgaagcttgcgcgctctacatcccattcgtagtattcttctactactacatcaatgaagttttcgctctttacaggaggtacgattctgtcaactgcacagtctgggaatccgacatactcatctgcaaatgcttttccttcctcgcttaagttttcgtaaacagctttctttaactgagatgttccacggattgcattttcacatgcgatgatgttcatcggctctttgtttccgtctgccatacgtttttcgatagctgctgcgattgtaggagcgatacgaggtaaaataacaagaccaacagctgttgttacaaggtcagcacttgcgatttcatctactgcttctggctttgtagaatttacaccactgatgttttcgattttctgatcttcacattctacgtccattacatgaactgtgtatgttttatcctcattaattttatcgataatcttgtctacaacgtctgcaaatactacatgataaccggactgactaagtaaagctccaataaaaccacgaccgatattacctgctccaaactgaactgcctttttcataatctgactccttctttcttaaatctaaacctcgggactattcccgatgttatttcaatatgattttttaatatagtttttacttaatttaattactcacctttgttatttattttaaccaaaagttttcatgatagtgtcaacgtcagcattctttttcagtgtttcgagaagttcttcgtcctcaagacttgctacgatgtttccaagaatctcaagatgctcatcaccaacacctgcaataccgattacgagatatgctttctcatcaccaaagtcaacaccttctggatactgcattactacgataccagattttttaacggtttcttttgcactggatgttccgtgagggattgcaactcccatacccatgtatgtagataccatattttcacggtcaaccattgcctgaatataatcttcatttgcgaagcccaggtcacataaaagctgacctgctgcacgaattgctgtttctttgtctacactctttaatcctgttttgataccttcttttttaaggacagctttttttgctttcttttcttcttttacttcaggttctgcctctactgctggagctggagcggatgtagcatttgcacgtccctctaactctgcatagaatgtatcaaggttaggatcctgaaggaagtttccgattgctactaatcttgcctgtggtgcactcttcactgctctgtcctgtaaaatgtactggcatacaacgacatctgcgtctgcaggaacattgtctacagatgtatttgttactgtaattccaagatttaaaggtttaatacgatttctaaactttgttgctcccattgcggaagatcccataccagcatcacatgcgaaaacgattttcttaatgtcatctgtcttaacatctgctccggaaagaacttctgctgcctgtcctttggactcagctttcatgtcgcttgtctttttctgtgcatcttcaagactcttgcttcctgccatcttaacgatcggtgaagaaactaagaaagatactgctgctgcaatcagaacaccaagtgctgtgattgcgatagatgtttttggtgacattgacataaatgcgatgatagaaccaggtgcagaaggtcctacaagacctgcttttgtaatactgtagaaaaggattgcacagatattacctgcgattggtccaacgattactaatgggttcataaggatgtatgggaaataaatctcatggataccaccgaagaagtgaatgataattgctccaggtgcggaatcctttgttgctttatccttagaaaatgcccagtaagcaagaagtaatccaagacctggacctgggttagcctctaacatatacatgatggacttaccagcttctgctgcctgttcaattccgataggagtaaagataccatggttgattgcgttgttcaagaataataccttcgctggctcaataaagattgctgcgagtggaagaaggttatgatttacaagtacctgaacaccaccttttaatactacaagtacggcactcatgaaaggcccgattgcatagtaaccaacgatggctaataacataccgaagataccaatggagaagttgttaattaacatctcaaatccggctggcattcttccgtccattgcctggtcaaactttttaataacaaaaccagccaaaggacccattaccatagcacccatcaacattggataatcaggtgctccaacgattacaccgatggttgcgattgcacccattactccgcctcggtctccaccgattaacttaccaccctggaatgcgatcaggactggaagtaagtaattaagcattggtccgtttaaagttgcaagctgtgcatttggaagccatcctttttcgataaataatgctgtgatgaagccccatgcgatgaatgctccgatatttggcattaccattgaactaaggaacttaccaaaacgttgtactgcgtttttcatgttacatatctcctctcttttttgcccctccccatcggcttaatacctgtctccgttttacgttttgcctccggctttgggatattgacactgtgtttttttgcactgcctttgttctctatgtctatattgtaaagcacaaaatgacaaaattcaaaggaatgataccgcaactttgtcggtaagacttcccgacaaactgtcactttatcatcaatatacccaatttctttgtcgttcttttgtgcattttcacaagaagtatttgtcagtaaaatattgtataataagaggaagaataggaaaggaagaaaaaaatcatgcagctcacaccacgcgcagataaaataatccgcattctgctccgcttttcaccggacagccctgtgacaatcggtatcatttcagaagaactcggtgtcagcgaccgctccgtccagcgcgaactgccaaccgttgaaaaatggatgaagcataatggcttttgctttgtacgcaaacgaagtgtaggacttttaattgacgagacaccagaacgattaaaagagttagctgctcttttagatgaaaaagatacaaatagctccgctcctgcagataaccgcccagaaaggctgactctcttatgtcatgaccttctcctcgcagaagagccgattaaatcttactacttcacagaaaagttcgagatttccgagggtacacttactgctgaccttaaccagcttgaaacctggtttacaaagtatcagctaaagctcgtccgccgtcccggacttggtgtatttatagaaggaacagaaatcgcaagaagacaggcattgacttctttcatatgtaaacaggtaaatgaacatcactccattggcaatctccaggacaagaagtttctgtcagaccgaaattttatcaatgaaattgatggcgaagtaatggccgaggttaatcacattcttggcggctgtcagaaacagcttggtatgcagctttctgacaatggatatttacacttgcttgtatacacttccctctgtgtacagagaatgcaaaaaggacggtttatcaaagaactcaaacagtcttatgcagaaatatctatccagccggagtatgctgtttccgaatatattatgaaagaactacgccagtttttccatttatctatttctgtcgatgagaccatctatatggctgtctttatttccggacagcgtatatggccatctggaagcagagatttaactgatataaaaaaccttgacgtacatcagattaccctgtccatcataaaaaaagtcaacgaaattttacatataaactttatgagagacagccggctcctcacagaattaagcggacatatccaaccgaccattgccagactccgcgctggaatccctgtagaaaatccgctgttaaaggaatttcaggaaagttatccttctgtatataaggcttgtgaagagggactttctctcctctgtccgattcttggcataaaaaaagttcccgccagcgaaattggttttattaccctttatttcacaatggcaatggaacgtattgaaaaagaaatcaaaaagctttctgttatgattgtctgtccaactggaatcggaagttcaagacttctcacagagagcttgaaaaaagaataccctgaccttgatatccgcggtataacctccgcttttgaattagataatattcgattacaggaagaaggcgttgaccttgttatctccactgtaaagctagagattgcctacccatacatccacgtcaatccaatattaacccgtcaggataaaatactgctcgattctcgcatcaaagtcattcaggaacagaaaagacaggcacaggaaaaagaaatcaaagaacccgaagttccttctgattcctcaatctgtagaaaagatgtagaatttctctccgccattggaagcgaaatctatgaactgctcggcaatatttacatcaatcaggctccaatcctgaaaaacagagatgaaataatctcttactgttcctccctgtatgccgacacttccgacatgcagacacatttatacaaaatattaaaagacagagataacctggctgatacctatatcaaaccatttcaggcacttctccttcacggaagaagtacagaaatttctacctcctgcttcggttacgtccggcttgaaccaccaatctatgaacgtggacatattatccggggcgctattgtatctctgattccctcgggacctgcaagtgaagttgctgccccggtaaccagtg

SEQ ID NO: 438 - DNA, 28100 bp, Eubacterium hallii
ataaaattgctgccgcagatatgattctttttgctacaccagtttattggtggggaatgtcagcacaattgaaacttatcattgataagtgctactgccgtggattgcagttaaaaaataaaaaagttggcacgattgttgtaggcggttctcccgtagacagtatccagtatgagctgattgataagcagtttgactgtatggcaaaatatctttcatgggatatgcttttcaaaaaatcatattacgcaacagccagagatgaacttgaaaaaaacaaggattccatgaacgaacttgaggagatcggaaaaaatttataaagcacgttccaaattcaagtttgttgaattaagaaaatcgttgtttatcaagctttttaattttgaaaatttctttgaaaaactattgactcctacgtaacgtaatagtttagagtatgtttatcgagaggaggaaatgacaatgatgacggtgaatatggatggattaaaggattttgtagttcagatgcttgcgggtgagcctgtttcaatcaatataggaacattcagcaataatatgactatatttgcaacaaaaaataattcagatattacgtaatcatttctctacttacctatgcctgatgcatcaaaaagaagttttgaagatgcggtgctacgcagttctttgaggaagacaatgaagtaaatcttcaaaaaaagattgaaattgtttataatcgtttataaaggagaaaataatatgagagtttttgttgatgcagatgcctgcccggtagtaggtattattgaaaaagttgcaagagagcacaatgttccggtgacgttgttatgtgatacaaatcatgtgttatcttctgactacagtgaggtgattgtagttggagccggagcagatgcagtggattataaattgatcggcatttgccataaaggtgatattgttgtatcgcaggattatggagtggcagcaatggcacttggaaaaggtgcatatgcgattcatcaatctgggaaatggtataccaatgagaatattgaccagatgcttatggaacggcatttgaataagaaagcacgaagggcatctagaaagaatcatttaaaaggaccaagaaagcgaacatcagaggacaatgagcgttttagagaatcttttgagaaaatgatacagattcttcagaacggttagttacgtgtagaatgacattgactagatttatctcagtcgagaagactcccgcttctttcaggtggtgagtgactgctcgacttgaatttgttattctgaaaacttatcgctgtaatgaatatgcatatcctcccagtccataaataatacataaaatacccgaccgtattgctggctctccacgattcttccatgatcaagtacggaaaggtaggttccgtccgcttttcgtagatgaaagtgaatatagtcattttcattgccattatcaatctgttcccagatgcttgattcaatttgtttttgctcatcttctcgaatcaggttacggaagcttttctttgtaagcctaaagagttcatccatatttttatatccggtcatatgaaggaactcgtggtttgcataaaaaagttcatcatcttctttgtctgctctgtatatgataaatgcacccggaagatgttcggaaatatctttaagtgcaaatcccagctgtttgcgaacacctgatgaaagtcctgctctgtaagccatacatccgttttttccatgaagttttatttcgtaaagggcggtatctgcacagcgcatgagctgtgaacggttggaagcaaatgtcggatattctgcatatccaagagaaatatggaaaggatattctttccccatatatgagaatgtctttggaagtctggtgaattgctgtaatagttcttctgcttcttcacaggtataatttggaagaagaatacagaactcgtcaccaccgtttcttcccagcaatgtatccggtgggaaaaaagctttcatattatctgccagactctttaatgcattatctccataagcatgtccatagatatcattaatagacttaaagtcatcaatatcaaggagtgcagctacaaaatgcgattttggatttttatcgatcatctttactgccaattcatcaaatccatatcggttataaatatctgtaagagaatcggtgtgtgccagtattttaaatttatttttatgctctttcgatactaaccagacccgggtaagaactgacaggagtatgacaatagcagcaaaaatcacaccgacttctgctattaatgtattgttttcccatccgctttttggagtcacttcaaatctccagttctcttcccctattgtaaatttataagaaactggatgtgttaattgacgatctgattggtaaacaactttgtaagtatcactccagggagcgtctgtttttgaaagtctgtattcatatccaaaattcgaaagagcattgagtgtatctgaaaaaatgtcaggcacatgcaggataacaatagtaaatccccagaaatactcctgtccattttcatctttcaggtaaaccggattgcggacagcaactccatagccactctgtttcaattcgaaaggtccctgtgtaatgatcgtatggttgtctcttgcgtaacgagaaattttaccacgatttttgtcatggatcagatcaatcttacccgcttcatttccactgataggataaatatctgtcacaacaccatctggggcaagctgcacactttcaatagagtcggacataagattttttgcaatggtatcaaactgattaaactttccattttcactgatcaaaacttgtttcagagtatctgtaatcccgattccgtgtgtaatctcattctttatgcgctcaccataagtggatgcatttaattgtgctgttgtgtgtctctgctctttttcgtggatgtctgttttgtatacaatgaaaccaacaaagcatatgcccagtaaaaaaacgataagaggcacaagtactttttttttcacctaattcacctcgttcttatacatcagatatttttataataaagaattataacacagaagcagcaggatagaatatattttctgaaaaaatacaatagagtaattttttataataaatttacattgaagtgacaatgtttttcttgcacagggtggatagttacattaaaataatattagatgctactaactatcttgcagcaggatgatagaaaacagactcatactgtgcaataatcagggtattagaaaaaataagatttttaacatgacatgaaaggaagagagattatgattaagacaacaataaagattactggtatggcctgcaccatgtgcgaagcacatattaacgaagcagttcggaatgcattttcggtgaaaaaagtgaaatcaagccattccaaaggagaagcggtcattctatctgaagaaccattagatgaagcagtactccgaaaaactattgaagctaccggctatactaccggagaaatgacttctgtcccatacaagaaaaacggtctcttttccttttggaaaaaatagaaaaaattttgagtaactggggtagccgtcatgctggcaccctgcttttgacaggcattttttatggtgtaaatcgttgtttgtgtttatgaaattatatatggtataatagcaaaaaacatcacaaatggagagagttttatgaacaggttcaggagaaggctaatattgacatatacgcaagaatggcatatatggatacaatgaccggtcttggaaatagaacggcatttctggaggaaaataaaagtaatgctattttccctggaatgatttcctacataatgatggatgccaataatctaaaaacaataaatgatacattgggacataataaaggcgatgaacttattattacgattgcaaagtgcatgagaaaagctgttggacataatggtcaatgttatagaatcggtggcgatgagtttgtaataattctgaaaaataagacggctgcagaaacggaggaaatcataaacaaggtaagatgtgagattgaatttgctgataagcaaagtgatattactatttctgtcgccataggatatgtctggactgatacagaacaaaagaatttagaagatcttatgcagcatgctgacgatgaaatgtataaggataaaaagaagacaaaagaaaataaaagcaaagaaaatacgcactccatttaaacaacaatgtagaaaagtacattagggtatgaaaggtgacattatgatatatacagtaaaaagaatagaagaagacgtagattacggttgtgaagaacgtccggaagatgtaccagtcatggcggtagttacgcttacgaattctttgggagaagaattggtaataaaagcagaggatgctatgctttatgaatgtaatattaatgaaggagacaaggtaagcattgatgcgaataataagttagaaaaaagctactaggagggacagaatgagaaaacttatgattttatttccgggaatagggtatcattgtgataaacctatattgtattatggaaaaaagattgccgtaatgaatgggtataaagattgtatcagcctgtcatattcttatgatggaaagaatcttcgaggcaatactgctgagatggaaaaagcttttaacagtttgtatgaacaggcagaaaaacagctcgatggagtggaatttaatcagtatgatgaaattctgtttgtctctaaaagtatagggaccgtcattgcagcagcatatgccaggaagtacagtatagaatgcagaatgattttttacacaccactggcacagacatactcttatgatgtggaaggagggattgcctttatcggaatgaaagatccatggagtgatgtggatgaggtaattcacgcaagccggaagcagaggataccgatttatgtatatgaggatgccaaccattctctggagacaggacaggtaatacaagatctggatatattgaaagacgtaatgataaaaacaaataactatctttcagtggaaaaacattgataaatttttcgggatttcgacagaaagaatatagtgcagatttgaaattgtgcagatagtcttgcataattagaaaagagtaaattataaaactatgaagtgaggtagtggatatggaaaaagacccgtttaaggaatatctaagggagtctgaaccagataaagctcataaaggttatgcttggagtacagcaatcggacttcaggcagtggacggactcaaaccatctaaatatttgattgatactgccattcagaatattgaaggcaaaattacaatgcaagaagcacagaaccttattgacagctactatgaagaaagaccggtgcctttgtctgatgatgaacgtactgaagaagcagatagggtttcggcccgtattgcggaaattctttctgaaacagcgttttcattttctccaaatgagtatatatctatccaccgcaaactctttcagggtatttataaacatgctggaaagattagagattacaacattacaaagaaagaatgggtacttgatggggcaactgtaatgtatggtagtgcctccgaactgagagccacacttgaatatgatttttcgcaggagaaaaattttagttataaagggctttcaatggatgagattatccatcatcttgcggtattcatttcaaggctatggcaaatccatatctttggggaaggcaatacaagaacaacggcggtgttcttcattaaatatttaaggacactggggttctctgcaaccaatgatatttttgcagaaaatgcgtggtatttcagaaatgcacttgttcgtgcaaactatacgaacctgcaaaaaggtattcacgaaacaacagaatatttggaagtgtttctcagaaatctgcttttgaacgagaaaaatgagcttcacaatcgaaatcttcacataagtggacttttgaatgatacaaaagtggacattggagctggaaaagtggacattcaagacaaaaaagtggatattgaaagtgtactttctgaaaagggcaggaatttctctgtaaaaacaaaagttcacatccttagactttttgaggagtttggttttgatgaagtttttggaagaagtacagttatggaacttcttgaactgaaaggttcaggtgcttcaaaacttctttccaagctggtacaggcagatattattgaaccagtatccggtcatggaaaagggaaatataaattcaagaagtaatctaggtgttgtaaaagttttagggcagatttgattcatgtgagtcaaatctgcccttggttggaactatctatttcctgacagcccctttgctactatccatagttacgaaataaaacattctttaacctgtgtttgataagcgattttttctattcaaacatttactcaaacacttcttcgattccacctgttttttcgttgtaaacataaacactgttgtgttctgttacaaaaggagtaagtgagccaagcttaatgtttcgaatgtatactacattcgttggtaaaactcgcactaagctttcattttcattaatatcagcgatccaacgaaacaatttgttctcttcttgtcccgtataaatgagatccataccgttttccgtattctctagtttgaaatataccttatgttttaaagccattttcggatagacaccttttacaacataaataccataatgttcatgtaaaagctccttataggtatcggatgtaagatcaatatcattatatttcactttttgtccaacatcaattctttcgcgaataatggtcaaggtatggatggcccaattgagtgttccaatactgttgtacttgatgcattcttcaatatttgagaagaacgtctcatcaaaacttacttcctgtgttgccatttttgtcagttcgtttaatgataaattcatagtaatcccccttcgttaagcaagatattgtatacgatttaaaaaccatatgtgtatcatagatacttttaggttttgtaaacaaggtatttgaagggaaatacagacaaatcagagttattatccaatcaataatcaggagaatcagaagtgattttgtaatgattgatgctacaggaaggaagaggaagtatactcttttttattgacaaaaaacaaccacaatattattatataaagtaattacataaagtaattatgtaaaataaaagaaaggagaaactcatgacaaaagataagataaaagaagttatggatgcctgttatcaggcaaagaggataagagatatgctgccggcattgcctgggggagtgacaccatcccatattcactatctggatactcttagaaagttagaaaaaatggaaggaaaggtaagagtcagtgatatgagtgagaaccttggacttccgagaccaagcgtaacgaaaaccgtaaaagatatggaaaagcttggatttgtcgagaaagaaacaacagaaacggacggaaggtttgtttatattaagacgaccaggacaggaagagacctagttgataaatatgttgatgagtattttggtaatctttcggaaaatcttggagggattacggatgaagatgcagataagatgattgaagtagtagaaaagctctatatagtcatgagtaacaggaagtaatatatgaatgcaaaagaaagatcagattttacacagggaagtatattaaagaagatgattccattcatgatgccgatacttggagcgcttatactccaggcagcgtatggtgcggtggaccttctggttgtgggcagatttggaacaacagccgggttatcagcagtttcaacgggcagtcagattcttaatcttgtaacatttgtgataacgcagttagcaatgggaattactgttcttattgcaaggtatatcggtgagaaacatacaagtcaaataggggaactgcttggtggagcaacgacagtgtttactatgatagctgttgtactttttgtggtgatggtgttttttgcaaagccgttggctgttcttatgcaggctcctaaagaagcgcttatgcttacgtcagtgtatgtaaggatttgcgggggaggtattttctttattgttgcttataacgttctttctgccatattcagagggctgggagacagcaggtctccgcttatatttgttgcggttgcctgcgtggtaaatgtcgtaggtgatcttgtacttgttgcaggattccatcttgatgccgcaggagccgcaattgctacagtgcttgcccaggcggtcagtgtggtgctggctcttttgatgcttaaaagaagacagctgccatttaaaataacaaaaaaagatttcaggtttaatagtcaatgtaaaagattcctgacagttgggattcctcttgcgcttcaggaatttcttactcaaatgtcatttcttgcactgtgtgcatttataaataagttagggctggaagcttcttcaggatatggggttgcctgcaagatagtaaactttgccatgctgataccaagtgcacttatgcagtcgatggcttcttttgtatcacagaatgttggtgccggtaaggaggatagagcaaagaaagcgatgtttaccggaataggaatcggattaattgttggaatcgttgttttcataagtgtatggttctttggtgatgtgcttacatcgatattcacaacggatgaagcggttgtacaaaaaggatttgaatatcttaaggggtttgctccggaaacgattcttacggcaattcttttttctatgataggttactttaatggacatgaaaagacgttgtgggttatgattcagggacttatccagacacttcttgtaagactgccccttgcatattttatgagtatacagccggatgccagccttactaatatagggcttgcggcgcctgttgccacatgctttggaattatattaaatataatctttttcattcacatgacaaagaaaatgaaaaaggtataagtaaatcaatgatttatctcttgaaattttgtttacaagtagatataatgctttttacattttataatttaggagaaggtatttatgaatagtaagtctaatacacaggcgatggaaacagaaaaagtaccacgtcttttagcgcaacttgcaattccggctgttgttgcacaggttatcaatcttttatataacattgtagaccgtatttacattggacatatttccggtgttggtgcggcagcattaaccggtgtcggattatttacccctattcttatgctgattaatgcatttgccatgctcgctggctctggaggagctccgcgtgcggctatttttatggggaagaaagataataagacagcggagaagattcttggaaactgctttgctcttctcattgttatggctgtggcacttacagcgattttctttatttttgccccacagctgctaacgttgtttggtgccagtgataagacacttccttatggagtggcatacgcaagaatttatattctcggaagcatttttgttttgatcgtaatgggaatgaatccatttattacgacacagggatttgcaaagatcagtatgatgacgactgtaattggtgctgtaattaacatcattcttgatccgatttttatctttggatttaatctgggagtaagaggtgctgcgattgctacggttttaagtcaggcggtcggtgcgatatggattcttcgtttcttatccggaaagaagaccattcttcatcttagaaaagaaaactttaaattgcagaaagacattatcttaccttgtcttgcacttggtatttctacctttgtcatgttatctacagaaagtatcctgtctgtcagcttcacgttcagcctttcaaggtatggcggggatcttgctgttggagccatgacaattattacaagtgtcagccagcttgccacattaccattacagggaatctgtcagggtggacagccgattatgagttataatttcggcgcaaggaataaagagcgtgtaaaaaaagcattttttacacaatttacagtctgtatagtctttactagctgcttctggctgattatgcttttgtttccgaaactgtttgcaggaatcttttctaataatacagatttgatcacttacactacatgggcattgagaatttatatggctggtattttctctctcggatttcaggttgcctgccagcagagttttatggcattgggacaggcgaaggttagtctgctgcttgcctgccttagaaagctgatcctgttgattccgttaatctttattctgccatgttttatccagaataaagtatttgccgtttttctagctgaaccaatcagtgatatactggctgcgataattacaacgttaactttctttagccggtttaataaaattttggataaatagtaggaggtatattctatgccattgaaaattgttagaaatgatattacaaaaatgaatgttgatgcaattgtcaatgcagctaatacatctctattaggaggtggtggggtagatggatgtattcatcgtgctgccggaccagacctgcttgcggaatgtaggatgctccatggatgtgagacagggaatgctaaaattacaaatggatatcgtcttccttgtaaatatgtcattcacacagttggaccaatctggctggatggaaaacatcaagaacaaaaacttttagaatcctgctatgctacatcactgaatctggcgaaggaatatggctgtgaatcggttgcttttcctttgatttcttctggaatttatggttatccaaaagatcaggcattaaaagttgctatagatatcattgggaagtttctactggaaaatgagatgacagtcttcattgtaatttttgaccggaaggcatatcagattagcggaaagttgtttgcggatattacagcttatatagatgaccgatatgtgaaggaacattcggacagtcgggaagaactaagacggcgatcggagccgcttcttggcgaaagctgtttcggatcagccgtggagaggatggaagagaagccaagctgtaaggcgataagcagcaggactctggaggatgcgttgaatcagatagatgaaagtttttcggaaatgctgcttcgtaaaattgacgaatccgacatgacagacacgcagtgttacaagaaagcaaatattgaccggaaacttttttctaaaattcgtttaaataaattttataagccgtctaaaacgacagtgctggcatttgcgctggcattggaactgccaattgcagagatgcaggatatgcttggtaaggcgggatttactttgtctcgttcaagcaagtttgatattattgtagaatattttgttgaacagggaaattataatgtatatgaaatcaatgaagcactgtttgcttttgatcagagcctgattggatcataaaacaatgaatgttgtttaatgtcgctttctatgcgaccactttctaaaagaaaatcgttatactatggctgcaaggtacgaaaccgagcagccatttttttgaccaggtaaataccgggatagtaaacctaatagcgagattttcaggaggtaaggtataatgagaaagaatttaacagaaatcgtttttatccttgatcgtagtggatctatgagtggactggagcaagatacaatcggaggatttaattctatgattaagcagcagaaaaatgcagagggagaagcattgatttctacgatattgtttgacaatgtaagtgaagttctgcatgaccgcataaatgtaaaggacatccagcccctgtccgatcacgattatatggttcggggatgtacggcattgttagatgctattggcggagcgatacatcatattggaaatattcataagtatgcaaggcgggaagacgttccggaacatacaatgtttgttatcacaacggatggaatggagaatgccagccgctattatagcagcaataaagtgaaacagatgattgagcggcagaaaataaaatatggctgggagtttctattccttggagccaatattgatgctgtggagactgccagtttatttggcattgacgaggacagagcagttaactatcaatgtgacagcgagggaactgccctaaattatgaagtgatcagtgaggcaatcagtgctgtccgatgtagtgcaccgttgggttcaaactggaaaaagcgcattgacgaggattttaaaaaacgtggcaatcgcaagtaagtaattttctattgttcttttacctgtcttgtacccatagatagaaaacaaaactatgtattgataatatattttgtggtagaatgaagaaaatcaatataatttgtaaactagatgtactcagagaatcttttatctcagtcgagaagactcccacctctttcaggtggtgagtggctgctcgacttgaattgattctgtgagtacatcttgaagtcgtggaggtagaaattgtatggagataacggaatttataaaagcaagagttttttcaaaaatatcgaagtcgttatataagtcttttatatcaaagatagtggttgttattttggcagtatttttgctagtatcgggaagtagtcagatagtttgtgcagccacatcagaatcagaattcatgattgttcaggaaaaggtgtataaggatggtgaattatacaccggctggtgtagtatgggaaaaggacagaagtattatgtggttaatggtaatagagtaaagaactggtacaaggttcgaaaaaagtattattattttggggacgattataatcttattgttaatagtattgtaggttcgaaggcaaaaggatattattatgttgataaaagaggagtcagagttactgcaaaagaaatccgacaggctgttacatttgttatgaagtattctgatgcaaaatttagcaggcagaagcgtttaaaacaatgttttcgggccatacgtaaatatccatatcaccatatgagttctgttgcaccagctgcgaagaagatcccttcctatgcgaattatatgtttactgctcaaaaagggaattgttatagatatggttcggcaatggcttatataggcagagttttgggatatgatacaaggcttgcagttggagctgttacatcaagaggaccacgtgcctcattatcgccacatggctggtgtgaaataaagataggtaaaaattggaaaatgatagactgcagtatgcagcgatttaatctgaaaaagaatttatttttagtaactcgtaagaaatatccatatcgcctgagatgtgataaggttcatgctatggtagtaagaaatggaaaggttaaatggttttaaataaaaaaattttaaatataaaatttttatttgaaactttttctacttgcatttatatttagttttttgtcaagtttatataaggagatataaattatgaagattgtatttttagatacaaaaaccattggagaagatattgatttatcggcatatgatgctctgggagaagtggtaaaatatggattttctactttggaagagattccggagcgtgtaaaagatgcggatgttttaattgtgaataaaattgcgattaatgagcagacaattgggactgcaaaaaatttgaaattagtatgtgtaacagctacaggaacaaataatctggacaaagaatatctgaaaaagcgtggaatcgcatggagaaatgtagccggatattctacagaatctgttacacagcatacatttgctttattattctatcttttagagaagatccgttattatgatgactatgtaaaagacgaaaaatatataaatgatacggtgtttactcattttgcagagcattttaatgaagttaacggaaaaacatggggaattatcggacttggaacaatcggaagacgagttgctgatattgcaaaagcgtttggggcacgtgtgatttattactctgcttcgggaagtccggcacaggaaggatatgaacaggttgattttgaaacgttacttactacatcagatattgtgtccgtacatgctccgttaaatgaatatacaaaagatttgatggatagggaagcatttgcaaaaatgaaaaagacagctattttcttaaatcttggaagaggaccgattgtagtagaacaggatttatatgaagcattggaaacaggtgaaattgcagcagcaggtcttgatgtattatgtgaggagccaatgagtgaaacaaacccattggcaaaaataaaagacagtaaaaagcttattattactccgcacattgcatgggcgagtgtagaagcaagaaaccgattgatgcagattatcgcagaacagatcagggaatttttataaatcttttgcagactttctgagtgccacataggaaatcagaaagtttgcaagccagccggctggtacagctaaccagacaaatgcgataccaaaacgtggtgcaaaaatcagtgcaactgacagacggatagcaagatttaccatgtttgcaatgagaaatggacgcatgattcctagtccacgaaggacgccatctgttgccatcttgattcccatgaagatgaagaaataaccgagccatctcatgtaatcaccggatacctggtaggctaaggctgttccatcttttcctagaaatagtgaggaaatttgcgtgtgcaatgtttcaataattaggaaggcgaggaatgcaaaacatacatccagcaataatgcagcgcggtagccctttttaatacgccatggtttctttgcaccaagattctgagaaacatatggtgaaacggcattgccgatggatacaaatatcagtgaaaaaacattttccactctcattgttgccgcataaccggcaagtgcttgtgtaccgaatggatttacaacagcctgtactatcatcataccaatggacacagtggactgctggagaactgacggtacggcaatttgaagcattgcatagagttcctgtctgtcaaaccagttaaagaagctcttatatttccgaattcgatgaaggaagattaaaagcgaaaatactgcagagataccctgtgagatcagtgtggcaagggctgcaccgaatacacccagaccaagacctgccaccatccaaagatccataaagatatttaaaatagaagaaaatattagaagacctaaaggaatctttgattcaccgatggaagtgaacatggtggagagaatattgtacataaacagaaacgggaatcctacaaaatagacacgcagatacagcactgcttcattcagtatatcatcaggtgtctgcaaaagactcatcatcaaatgagaaaaacaaaagcctaagccaccaaggattatgcttagaatcaaaaagctgatcagtgatgtggatatgattgttttcattttactataatttctggcaccgaaatagcggcttacgagtacaccggcacctacaccggctccgagtgctatgcaaatgaaaacattcgtaagtgctgcacaggcgccaacagctgcaagtgcagaggagccgacaaactgaccgacgattatggaatcggccatattataaacttgttgaaaaaaactgccgagaatcatcggcattgcaaaaatagtcaacgccttaaggggcgtatctgtaattaaatattcatcttttgacattatcatactacctctgagatttagttaagaataaatggatgttacgaattactccgcagctaaacgctactctcgtaattcaagcatcataacattattataacacagtttaagctcccaaaatgataaatttttggagctgctgcaatgacagcaaatgcatttgcagaagacaggataaaatctaaagaagcgggaatgaatgagcatatcgcaaaaccaatcgatatgaagcttctggtgaacattattgcacagttagtacattaggcttagaaaggaagagtgcgcttatgagtaactatatcactacatacacgagaaggcattttgaccctgtaaaccctgagccagcggatatggatatcaaagacatagcacatgccctttcaatgatatgcagaggaaatggacatgtcagttctttctggtctgtaggggagcattgtattttatgtgcaaaggaggcggctgcaaaaggatatgcagatcgtttagtactcgctgcgcttttacatgatgcaagcgagtgttatatgtcagatgtgccaaggccgttaaaacagaacatgaagcaatataaagagcaggagaatcatttattagatgtactttatacaaagtttttaggaacacctctgagcgaagaagaggaaaagcttataaaagatattgataatgcattattgtggtatgatctgaagtatttattagatgagaaattagaagaaaggcagccgaagcttcatgtagagcctgattatacggtaagagcattttctgaggtggaaaaggaatatttagaaatatttaagcgatataaaatataagataaaatattaatgagttaaacgacaaatattataaaaatatacgctcggaatttttgacaccggttttcggttgatattccgagcgtaaataattttagcgttgaatggcaaaaggtgtactgtaccatatattagcataatcgctggtattatggtttaaaatatctttaagcaatttacatatgtgtgtgatctggctgtttatgtcattatcaactgtaccatatatctctccggattttattttctggtgcatttcgggattattattaattccgataatcaggggaaggctcatgttatgctgcttgtaatagtcatagacaccaagtgccatatcatcattattacatataactgcttctgcagaatgaatgagtgttttatctaagtttgcaaacttttcagtcgcaagttggcgctgccagtcagcagagagattggcgagctgattgagaggcagattttggctgctttcaaggaaaccatttgttcttcttatagaatcaaaatgtgtttgttctccttcaataagaatataatcgagcgtattatttttattatgatctaattttttctgattttttttccatgcgttttgaagcatatccgcctgaattgcaccagccttttttgcctgcgttcccacataccatgtctgtttggaaatagataaatcttttttgtctgtttctctattaaataaaatgacaggaagtttatggttcgctgtctcatttaggacgctagcagcagaagaaggtgttacaagattgatcaataaggcatcaaagttctgctcatacatgtattgaagctgatgttcctggcgattggcattaccttcggcatcaaagatttcataaagaattgttttgccgttaaaagtacaagtttcaagttcgttctgaagtttgtcaatatagtcgctcataaaggtgtcatccatgtcatagacagcgatgcctatatgagtgtactcattttggggttgcggtagcttccatattgttatagtgcttattaaaataataattagtgtaaacaaaatggaattataattaaaaagatttgttttcataactaaaatcctcatttttgttaatttgccagtagagagtttagttttccactttcgatagtctgtttatctaacttttggcatgaaacaatgatattttgcatatgtttactgcgagagtaggagtcaatcatttgaatataacaccttcatttcgaacccctaagacatactcgccgtaatcaacaacatctgcaaggaaaacagtagcacatccaagctccagaccagtaccggtttttacgataattccggcaatagcagttaaagggatattagaaggacagacaaatccaacaacaagcagtaaaataagtccaactggtggaagtgtacatgcaagtaaaaatgctttctttctagataataattttgtgactttagggaagattaataatcctactacttctgcaacggatgcactgatcataaaggcagataacattccggcattattgcatacatagctaaaataataggtagcaacacccataatagcttgaattccaacattgtataataaaattaaaagaacagcccatcttaactgatcattctttttaattacagtaaaaatatcgcggaatttcattttttctgttgttccggtattttgttgtttctttggcaggttaataacacagacagccattgtgaatataaatgtagcagcgataattaatgcgaatctgtgatatccgatataatttccaccaagtcctttaataatctgtacaccgaaaccagcaatgataagggactgaccaatactggcaaaaattcttggtaaaacagataccttttcacgttcttctggatcggaagtcagattaggaatgatagaccagtatggaatatccataattgtgtaggtcattccccataagacataaacaacagatgcgaatacacaaagactcacaccagatagatgaaaatcagtaaatacagtaacaaatacaaatgaattgattaatgttccaataacaagccatggtacgaattttccccaccggcttctcgtgttatcaacaatcatacccataaataaatcattaaaagcatcccataacttagcaacaaagaacatggttcctatgaaagcaggagcaactttaatgatatctgtaaaataaatcatagaaaaggttgcgatcattccatagatcaaatcttttcctaatgcaccgaaagcaaagcaatattttactcggcctggtatttttccctggtatactacaccactgttacttttgttctccattttgacctctcctctttttttattggtgttttttgacttggttgaagtttaacattttgccgaaaagaatgacatttgatattctattcaaaaaatatgaatttctattttcaggaattggattgaaaatcagcttatgatacagtacactaatgggaaagtatgcacaaaaagattccgagagtgcataagtaaaaagtagggaatatcgatcagatatatcggacatattagacatattatatagaaaggccggaagcggaaaatatgaaagagaaagaagatataagagagaataaatgggacaaattactgaaaatacatacaatgggacgtgatgattctaacgcagatcaatatcattatccatatgaacctacaccatattctgtattagaaagattagctaatacaggaatcatacgaaaaaataatacactgcttgattatggctgtggaaaagggcgtgtagactttttcctttcatatcagaccaggtgtacatctgttggtgtggaatatgatgaaagaatctataataaggcagtagaaaataaagaaagtgctatttctacaggaagagtatctttcaaagcggaaaatgcagaatattttgctgtaccaaaagaagtggatagaatctatttctttaatccattttccctggaaatattacaaaaggtaatgcataaaatattagaatcttactacgaaaatcctcgggaaatgaaattacttttttattatccgtcaaatgaatacatcgcttatttaatgacagtaaatgaattaatgtttgcagatgaaattgactgcagagatctatttcagaaaaatgattccagagaaaaaattgtgatatttgaactttaaaaatgatcttgatttctaagaatactcttttttgatactgacattatttctgaaaaaattaagactgcgaggtaaaataaaaatggaaaataaacatattcaaaattatcaaaatgaaaatacaaacaacaaaaatagaaaaataaattcaggagaaatacatattcataaaaacgaatatataaaaaacgaagataaaacacaaaataaataccatattcatgaagcagcttatatggacgaacatatgcaggaatatgtaggacagcatatatatgaacatacacatgtagatgaacatgggaaagctcatacacatacacatactcataatccagaaaccgtaaaaaatgaattgaatcgtattgcccgcattatcggtcatatgaagtcgatcaagacgatgattgaatcggggagagactgcagtgaagttcttatccagttagcagcagttgatgccgcaataaagagcctaagcagagttattttaaaagagcatatgtcaacctgtatcgtcgatgcgataaaaacagaagataccgaagcaattgaagcattgaatgaagcaatagacaaatttataaaataaaatactaatttgagggactaaagaaacgaaaaccagaaatttgatagaaaagaaaatgtgaagatagtcgcttcgtagaaaatgcctgaccggcagttttactggctccgacatcacattttcttttctatcaaatttctggttttctgtcctttggctccagatggaaattagtatttaaatcttggatgggaataaggggattgtccagaaggctatggtttttaatcagagaactgtttccccataagaaattcgccataaaaaaaatagcagtgaaggtcaaagccttccgattaataagatttctttctctataattccgttaacaattccttttcctttagaagaccggctacaaatccagtgggaaaatgttctcctctggagatttttattctagtgaaaaccatagacttctggacaatcccctctttttccctcagactaaaatactaattcctcatcaagaacagacagccgctgaaacaaacttttatgctgaattgtaagaagactatgataaagaaaaaagaatagttataagtattgcattttgtgactttgcgctgtggaattttgactctgaaaacttcggactcgttttttgaggcaaaatgaagcgtttagcgcaacggaacaaaatctaacttataactattcttttttctatagaagactaactacaattcagcttggtatcttctacataaagcggtgtctgtctccccagtaaattagtagtttgttgttgacattttcttggaaaaggattatgatatgcaaacaagttcattagtgaacagattcctaacgaactaaataaaggagatatgaaaaagattatgtattctcataaaagcaagcaaggaaagttttggagagtgcatgataacaaacggaggataaaatatgcgagattctatgatcaatacctgtggaatgaagatgcgtaagcttttggagaaaaaatctgaagtgctggtgcagaaatatggagtgagaaatgtggagttggagattcttttgtttttatatcattcatcatgtggagatacggcgaaggatatcgtagagcagaagaatttatctaaggcgcatatttcaaagtctgtggataatttgcgggcaaagggattcgttgttttgatagaggatgacaatgatcgtagaaagagacatattgagttgacacaaaaagcggaggaggcagcgaaggagatgttagaagttcataatgattgtaagcgtattattatgcggtatgtgacagaggaagaaaaggcagttatggatcgtgtgatgcagaagatgcttcgcagtttggatgaggaacttcaaaagtaacagaattagtctgattagaagaaaggaatgtagtatatgaagtcaatggcaatagaaagggaatttggcagcggaggacgggatatcggaattcgcattgcgaaagaggcacagattccttactatgatggacagctgctgattgaggccgctaaaagatatggcatagagattgcagatcttaaggagtttgacgagaataaagtaggaagtcttctctataatatcgcgatgatggcaggctataatcagtatgaaaatatggcgaaaattaatgagattttctatggaatgaaagagacgattaagagtctttatgcagaaggtccggcggtttttatcggaagatgttctacagaaattttgaaatcctgcgaagatgttgtgacagtttttgtccgctgtagtgataaggagaagagggtacagcgcatttttgataaggaaaatgtagatacgatgcagaaggcacgtcgtttaatggacagaaaggattggggcagggaaaggtattttaagttctggacgaaaaaggactggaaggacgagaagaactatgatctgattcttgatacagcgaagttttctttggaggagtgctcagagattttattgaagaggatgaacgagtaggcattggaaagcataataataaacgatgcggatttttgatgaacatagtagtcagagtaaaattgttttgacaaaaagtaattggaggacataaagaatgacaaaaatatttaaaaatatggccccatactggtatatgatcgttgcgattgtgctgttgcttattgtacaggcgtttggcgatttgtcgctgccgcagtatacgtcagatatcattgatgtgggaattcagaataaaggtgtggagcatattcttcctgtgaaaatgacggaggatgagtatgaaatttcgcagctgtatatgacttcgaaagagaagaaagtatggaaagatacttatgagaaaaagggtgagtattacatttgcaaggtagaggatgaggagaagctggatcagttagatgatacatttcttacagcgattttcttaaatcataacatgtcaaatgtaaaagaatcgcagtttaagaagatgattaaaaattcgattgcttcgaatcctgcgatggctccgatgaaggataaaatagatgatatgagtgtcgatgagattggaaagatgctcaacatggagtttaagagctttcaggaggaagatgataacgggaaaaaggttacttacgttgatgtgcgcccaatgctgtatcagatgaagcagacaggaatgatgagtgccaaagatatccagaagtccagagaagaaatcgaaaagaaaatgaacgatattggagagagtactttattttctacaggtgttgcctatgcgacaaaatgtgataaagctgcaggagtagatatcgataagatacagacagattatctctggaaagaaggcggccgtatgcttggaattgcatttatgattctggtagcggcgattggagtcggttttcttgcttctaaggtaggtgcgagtgttggcagggatttgcgaggaaaaatctataaaaaggttatgggattttcaaatgcggaaatgaaccgtttttctacagcatctcttattacaagaagtacaaacgatattcagcaaattcagatggttacagcagttatgctgagacttcttttgtatgcaccgattatcggaatcggtggaattattaaagtgtatcagaccggagcaggaatggaatggattattgctcttgcggttgttgtgattctcggatttgttatgctgcttgtctcgatggcaatgccgaagttcaagattatgcagacattagtagatggtcttaaccttgtttccagagagattttaacaggactttctgttattcgtgcatttggcagagagaaaacagaggaagaacgcttcgatgaagcgaataagaagttgacaggtacacagctttttacaaaccgtataatgacgtttatgatgccgggaatgatgtttatcatgtacagtgttaccattctgatcacatgggtttccgcacaaaaaattgatgcgggtacgttacaggttggtgcgatgacagcttttattacttatgcaatgcagatcgttatggcatttcttatgatgacagcgatgtctattatggtaccaagagcgggtgttgcagcagatcgtattgatgaagttcttaagacagaagcttctgttcaggatgtgaagaagccagaaacgcttaaggagcataaaggtgttctggaattctcacatgtagatttcaagtatccgggagcagaacataacgtgctttctgatattgattttaaagtggagccaggcaagacaacggcaattatcggaagtaccggctgtggaaagtctacgttggttaatctgattccaaggttttatgatgtgacaggtggacagattacattagatggcaaagatattcgtcggatttctatggaagaacttcgagaagaaataggatttgtaccacaaaaaggtgttcttttctccggaacaattgcttctaacctgcgatttggaaaagcagatgctacagatgaggatataaaagaagcagcagaaatcgcccaggcgacagaatttattgagacgaaaaaagaaaaatacaacagtccaattgcccagggtggaagtaatgtatctggtggacagaaacagcgtcttgcgattgcaagagcgattgcgaaaaaggcaaaagtacttgtgtttgacgatagtttttctgcacttgatatgaagacagatgcagcacttcgtaaggaattaaatgaaaaagtgcaggatgcatccatcgtaattgtagcgcagagagtcagcacgattttacatgcagatcagattcttgttttggatgatggaaagattgttggaaaaggaacgcatgaagaactgctgaaaaactgtgaggtatatcttcagattgcaaagtcacagctttctgaaaaggagcttggacttgagaaattaggtttggcaaaagaaaaagcagagaaggaaataaataagaaagaaatcctttctacaaaaattgatgagaaagaaaataacaaattaaagaaaaagtctgatgacaggaagttaaaacataagaaaggaggtaagtaaaatggctgaaaataaagcaggaacatcaaacagaggcccaatgggcggtcgtggtccgatgggcggcggaagaagaatgatgcatggcggcgagaaggctaagaactttaagggctcttttaaaaagcttttacgttatattggaaattataaatttgcgattcttgcggtaatgatttttgcggcaatatctacagtattttcagtagctggaccaaaggttatgggaaaggcaactactgcgctggccgaaggcctgatgaaaaagattgccggaacaggcgggattgattttacccgtatcggaaagatccttttgcttactttaggattgtatctgacaagtacagtgtttaactttttacagggatggattatgacaggcgtaacacagaaaatatgttaccgccttcgaaaagaaatctcggagaaaattaaccgtatgccgatgaagtactttgaaagtcgtacttatggtgaagttctttcaagaatcaccaacgatgtagatacattaggtcagggattaaaccagagtgtaacgcaggttattacttcaacagcaacgcttattggtgtcgttgtaatgatgctcaccatttcaccgttaatgacattaattgcatttatcattttaccggtatcggcaatcttaatgtctacagtcgtaaagttttctcagaaatatttccgcacacagcaggaatatcttggacatattaatggacaggtagaagaaagttatggtggtcatctggtcattaaagcatttaacaaagaaaaagatatggtaaaaacatttgatgaaaccaatggagtcttatatgaatccgcatggaaatctcagtttttgtcaggtttaatgcagccaatcatggcatttgtcggaaaccttgggtatgccggagttgccatttccggtggattgttagcaattagaggaacgattggtgtcggtgatattcaggcatttattcagtatgtaaagaatttcacacagccaatccagcagattgcgcaggttatcaatcaggtacagtccatgacagcagcctccgagagagtatttgaattcttagaagaagaggaagaagatcaggaacacgagggagcggtatctgtagaaaacgtaacaggagaagtgaaattctctcatgtgaattttggctacaatccaaatcagacaattatcaacgatttttccgtagatgtaaagccgggtcagaaaatcgcaattgtcgggcctaccggtgcaggaaaaacaacaatggtgaaactgcttatgcgtttctatgatgtaaatagtggtcagattcttttagataatcatgatgttcgtgattataacagacgtgatcttcgtaaagcatttggaatggtgttacaggatacatggctctataaaggaactattatggaaaatatccgttatggacgtttggatgcaacagatgaagaagttatcgaggcagcaaaagcagctcatgcagacagctttatccgaacacttccgggcggttacaacatggaacttaatgaagatgcaagtaatgtgtctcagggacagaaacagctccttactattgcaagagctattttggcagacagcaaggtaatgattcttgatgaggcaacatcttctgtagatactcgtacagaggctcttatccaaaaggcgatggataacctgatggaaggaagaacgagctttgttattgcgcatagattgtctacaattaaaaatgcagatgtgattcttgtgatgaaagatggagatattatcgaacagggaaatcatgaagaattgttggagaaaaatggtttttatgcacagttgtataattcgcagtttgaagaagcagcataatagagtttgaattctggtttgccgcaggcaagggagacgctcttagtaaataaaaatagcctatatttgtgactttagtcgctgcggtttgaatactcgcttacacacgctcgtatccaaaccttgctccgaggccacaaatagaggttattttatttactgagagttgtctttggaagttgaagaatagtcagaatttatgtttttgtgcgacttgataagaaaagtatgaaaaatatatattcaaatatttgaatgtgtattttgggacgaaaatgataagtgaaatacactggttttaaatagcgtataagagaatctggaaaaaagaatgtgacagcctatcttaagtaaaacttaaaaatacttaagataggctctttttttcttttttcatgccgaaataaggtataataaaataataaaaaatgttttacaaaaaaggttcttatcagtatttttttgtatagaggtttttataaatcaaatatgaaatacagtaataaatactgagtttggaagaagtttaagaaattattttagagaggcggataaatttggaagagaataattcaagtattttggtggtggatgataatccggaaattcgggaaattatacaggtattacttggaggagaagggtatctggtagagacagcaggtaatggtgtgaaagctttggaaatacttagtcaaagagagtatgatttaattattcttgatattatgatgccgggacttgatgggtatcagacatgccgcaagatgagagaagaaagtaacgcacctattttatttttaagtgcaagaacgaaagatagtgataaaacattaggattttcaagtggaggagatgactatctggcgaaaccgttttcctataatgaactgatcagtcgggcaaaggcgttaatacggcgatatcaggtttatagaggaaaagaagaacagacagtgaaattgaatcgtttttcctgtaggaatctgattgtggatgaagagactaagaatgtatattccgatggagagctgctggaacttacggatacggaatatgcgattttgctattgcttttgaagaatcgtcatcaggtattttcggcagagcgtctttatgaagctgtatggaaggagaatttttactatggtgcagagaatacagtaatggtgcatattcgaaatctcagaagaaaggtagaacgggattctaaaaacccgtccattataa

SEQ ID NO: 439 - DNA, 26468 bp, Eubacterium hallii
cattatttcttgctgcatgaatcgctgcttcattcataaggttctcaaggtctgctccagaaaatcccggtgttgtgcgggcaatctgatgtaaatctacatcttccgcaagcggtttgcccttcacatgaactttaaggatttcttctcttccttttacatctggtctgccaactgctactttacggtcaaaacgacccggtcttaaaatagcagggtcaagaatatctacgcggtttgttgctgccatcacgatgattccttcattcacaccaaaaccatccatctctacgagaagctggttcaatgtctgctctctttcatcatgaccaccgccaagaccagttcctcttcttcttgcgactgcatcaatctcatcaataaaaacaatacatggtgcgttcttcttcgcatcttcaaataaatctcttactctagaagctccgacaccgacaaacatttctacaaagtcagaaccggaaatactgaaaaatggtactcctgcctcgccggaaaccgctttggcaagtaatgttttaccggttcccggagggcctactaagataactcctttcggaattctggctcccacttcaatatacttttgcggactctttaagaaatctacgatttcttttaattcttccttttcttcctgtaatccggcaacctgatcaaagcagatattctgtgttcccggatcctgcatctttgcgcggctctttccaaaattcatcatcttgtttccaccgccgcctcctccggatgcacgactcatcatagcaaacataaacataagaatcacaccgataacaatccagggaagtatcatagaaagccagcctgcatcagatgactttacatcatctacatggcaggttactttatactgctgtgccagttcaatgactttattcacatctgtcacatgcactacctttttctctccatcacttagctttacgattgctgaaccggtcggtacctgtgcattctgcactacctccactgatcttactttattctttgcaatatcggactcgaatctctcataagagtacgagctgcttctgcctcctgacataaggctcttctcggcgaaataattgccaaacatatataccgctaagaataccaccagtaaaatggcagtatttctcatatttttattcaacgttttctcctttctcttccccggtaacattctctgctccctctgctgtttctggagcatcttctgctgcatccggctctacaactccaataaatggaagatttctatatttctgcgcataatcaagcccgtatcctacaacgaactcatctgggatatcaaatccaagataatcaatctgaacttctacttcacgacggtccggcttatttaaaagagcacacagacgaatacttgccggatttctctgttttaatacaggaataaggtaatgaagtgttcttccagaatcaatgatatcctccacgataattacttctttattctccatcgtatcatcaaggtccttcttaatacgtacgattcctgaactttctgttgcattgccataactagatacctgcataaagtcaagagaaactggtacagtgattctttttgccagttcgcatgcaaaaaatacaccaccctttaaaatacagattaaatgcacttctttacctgcataatctttactaatctgttctccgatttctttaatcttcgcatccactgtctcttctgggattaaaacattaattttatctgccatctttgtgtcctccattttaaaattctttactttcttctcttttttgcaccgatactttaagcactcgctttgtatcgctgcttaccttgtaaaactcactgatccgtcctcccaagatccacatgatatgggatccatctgccagcaaaacctgcttttctctatcggcagaaggaactttcgcatcaataaaataacgtgccagagatttatggtggccttctttatccataataaaataatcgccgctctctctggttcttaaacagggtttatatttcattttatcataatcgaagtatttcacacaatccctttttgcaactttaccgccattccatggtaaaatagaaaattctacttctaaggaatcttcgagcggattttctaaggaattttctaatggttgctctgcggatttcacagatttcgatttctttgtcagaaccaacccttctcctgtctttcttgcgagaacattataaggacaatcctgctgttttccttcctgattccccatgagcgtaagaagttgctcaatatgtacaagtgaaatatctttttgatgtccacatgtttcaaaaagcattcgccgcaagatttccttttgttcaaacaaatccatctcataaaatacctgttcttccagaaacaattcgccattatccctgtgaactaccttttccttatataatgcatccattttgggcgtaatatacgccaataattcctgcatctgcattccaagttcactgacatgtaccgttgctttcttattgatatgttccatttccggtaaaatgcggtgcctgatgtaattccggctatattcctcacatttatttgtactgtcatccacataatcctgctttaattcttttaaaacatctatgatttcttctctggacagacataaaaacggtcgaataatttctccgtttacaggtaaaatccccgccattccctgcacgcctgtcccacgtatcatccggaaaagaatcgtttccgccacatcattttggtgatgggctactgctatcttactacactgatgctgcctggcatagtttgtaaaacactcatatcgagcaagtctccctgcctcttcctctgaacactttttctcacgactttctttttttatgtcacgatattctacatgcagaggaatgttccactgccggcaaaattcccggacaaactcttcatctctttttgcctcatcgccccgaagcatatgatttacatgtactgcgtacaaatttagagccagagattccctttttgcaaggaaatatctcgccagacagacagaatctgccccacccgaaataccaagcaaaatatggtctcctctttctatcagcttccattttttcaaaaagcggtccacgcgctcccattgtttattccacatttctgtgtcctttctcccagattgatgcgaccagtactgtgcggtcatcatcataaccatcctcaagcactggaacagcctctatcagttgatctgcaaagacctgtgcgttatctgtctttattttttcaatcaggctttccatgcgaaatggaatttcaggcatactttcaaactccaacattccatctgacaccatgatgaccatatccccatcatatagctttttatatttcaagtcaaactgctggttgattcggcagcccgggggaagtgccgccggcacgatacgttctactgaatttcgatgccggataaatgtagccatccctcccgcttttaaaagtttcagtattcctgtttttaacgaaattacagccgcatcaatggtagaaaatgctttcctgtcctgaaaaagcaaggcgtcctgtatcatttccagcgcaaattcttcggaaagaccagcctctaacaagtcctctaatgtctcgatcagtctccggctatcctcatatgcctttttccctgttcccattccatctgaaagaagcatcactgccctctttcgtccaaaattcgtaaacgaaaacgtatctccacatacattttcaccttttttattacaacacttctgtccaaaaagaacatggaagccattttcttctataaaagaaagacgattttctcccggatgaagccagcttccttccatccctttataaaaggctttttcataatatttctcaagacattcttttacaagtagactcttcttcgttcccaaaatcgggcatacgagtaccgtaagctgtaacagcccacttccatccacatattcccgtcctcttataaagcgaagtccattcctgaaaaaaagattctttagagcaatcttctttcttccctgtatttcttctccctttttcatatggcctctgcattcttttataaacagacgctgctcatctaattgcctgcacatcacctgcttcaactcatcatatcgctgttcccaataaatattttgataaatgaggcggtacagccaggagatttcctccataaatggctgaaaaaacacacaggctctgcgaaactttgctgaagccatacgtccatctacaccggaacactggtaagcctgttctaatatagatgcgatctctccaatcgtctccttttgctttactccataacattctctatatttgggacattttctgcatacatcctgtgtaagggactgacataaaaagtccatatcatctttcgaaacatcctttttttcttctttcatcagaccaataattccagaaagtccttcttcaaaaaggagcaggcgctgtatggcatcctgctcggtataatttctattatgcataatgctcccctccacatacaacctaggaaacattataataaatcccaccagataataatgtcgaaaacagcattctgctttattaaaaaacaaagaatgtgccttggcacatcctcgcggagcgttttttactttacaggaaagcaatttcctgtaaagtaaaaaaagacccatccgggtcttaatcgtagtagcgggaactggatttgaaccagcgacaccgcgggtatgaaccgcgtgctctagccaactgagctatcccgccgcactcaacaggcaatatcataccatgttttttcaaatgtgtcaagcaattcttatgaattattttaaatattttctatggagtatctgtttcagaacctgcagattctgttgtctgtgtctcttctttgctgttctccccactgctttctttactactctcttcactggtatcttctgatgaaatgccggtactggcttcttcaccttcttttgcttcctgcaaagaaatctcaccttctttgatcattccaagacgttctctggcaatccgctctttaaactcgtccgtatcgatccccttattctccttctcaaatgttttattcgtctgttctatattcttgacatccgtttttaattcatctatcgttttctgatatttggctgctttcttctcaaccttctgatatcctataccaaatgctccgagaataacaactgtgcagattataatgatcgcagacttcttcgtaaaaaacttctttttaaattgtctgttaaactgtttactattcttttgtttttttcgtttttttatttttttcattttctctgcttttcctttattatttatgatttcttattattttaatagttttacgcatatttttcaatgttttacccgtatttttcacaattacttttccgggaaaaccaaaaatccctcttgcaatttttataatcctgcaaaaaaatccaacaagataagaaagaacttttccaacccatctgctcaatacaaaaaaataaagaagcacaccaccttctactccaaaaaggcaataaaaacgtatcattccctggttatatacctgaaataaaataaacagtccgattgccgccgtaaggcagaaaatgatgtcttccaaatggacgattctatttttatgtacaaaagtttttcgcaatatccggaagaattcataccagattccaagaagaacaccatataccccgctaagagaaaaaagctgcagttgtcttatgatttcctctgctattttcctgttttccatctaatggaataacctccttagcaagccccctttttcccctgtcattcctccttcatccgaataaaccatgctgtatacaagtccctctatttccacttctcctttttccaccgtcagttttgttacatgcagttcctctccctgaatcataagcatcccctgttctgtatctaaaatgatttcattggggtcaaacgaaatcacttcttttactccgcttataattccgctgctccggttaaaaatcgaaatcttatgactcttcaaaattctttcttccataagttttatcctcatttttattccttttattatatgtactacaaataaaatatataaccctggaaaaattacaggaaacaccttgacaaacatcgctaaaaccgttataactatggaagtacatgcgcttttgcgcgatatttcaacgagtcaattgtaagaatatcaggaggaatttatcatgaataaaacagaattagtagcagcaattgcagagagaacagagttaacaaaaaaagatgctgatcaggctttaaaggcattcattgatgttgttggtgatgaactcagcaaaggcgagaagattcagttagctggattcggtactttcgaagtaacagaaagagcagctcgtgacggaatcaaccctagaacaaaagagacaattcatatcccagcttccaaagctcctaagttcaaagctatgaagtctttaaaagagaaagtaaacaactaatctctagtttgctgacacattcatagaaggcattaaaagtcagcgtccgggaggacatttatgagactggataaatttttaaaagtttcacgcttaatcaagcgccgcaccgtagcgaacgaagcctgcgatgccggtcgtgttcttgtgaatggcaagactgccaaggcaagccttaacgtaaagaatggtgatgttcttgaaatccaatttggaaacaagaccgtaaaagccgagatccttgacgtaaaagacaccgctaagaaggacgaagcaaaggaacttttccgttatttataaaaagataaaaaagtcattatgtaataactgcgccttagagcaattgatggatgtggctaagcattcatccatcagtgatacgaagcagttttacataatgacttttttaagttctagctatgactaacttactgttttcatcgacattcaagtcgagcagtcactcaccacctaaaagaggtgggagtcttcttgactgagataatttaaatcgtaatttgtttgcccaaaaactcagcagctaccatcgcaacctttttctcaaactctccaactttatactttgggtctttggactgtataataatagaaccgataatctgcccgttactgcggatcatctgacggacctgctctatttttttcatttcatctgcaccacccatgccctctacaactggaataaaacgacttcgttcagctaatggcaacgattcgtcccggtcatctaaaatacgttctaaactatggctgatttccttaccaacaataccttttaagccatccccggcagcagcaattaccttttccctgtctgtaataaacacaatcttatctgtctgatgtgccacacattgagcaaattcttctgaaagaacagacatctccgaaaagggcataaactttcgcaatacaattccgccctctttatccgtataaatttcaagcggcatcccttcttttaccttaagagtctttcttatctctttagggataacaactcttccaagatcatcaattcttcttacaattcctgttgccttcataatatatttcctcctgcatactccttcataactattatgtactcacgaaatcaagcacaggaaagactccgggagtacatcaaataaatcgcataaatcacaactttatactttcatatcgagtgtcttatcggtagtatgtagaaattggataaaaatatacattggtatgatggttcttctttcacttagcagttcagaaattcttcgatttctttccatgcatttctggattctttcatcattttcattccaagctgaaaaacatggaacatttcatcgtaaaccgtaaggtgaacttcacatccagcagcttttgcctttttcgctgctcttacactatcgcttaaaagcatttccgctcctcctacctgaaaaagcattggaggaagcccttcataatcaccgtaaagcggggaaatgtatggcaatttcggatcgttatccccataatatgcattattgtagatcatactgtccgtcgtgttgccaaacagtggatctttttcaaagtttgtttcataggagtctccggtcgctgccaaatctgtccatggagacattaaaaccagcttctttggtaatggtttctttttatcttttaaataaagacaaagcgctaaggcaagtccacctccggcagaatctccgacaacaataatcttgtcactcgcacatcccatctcaagaagccattcatatgctgcacaggcatcttctaatgcggccggatacggattttccggcgcaacgcgataatccacagaaagaactgccctctttccaggcattttcgcatataatactgcaaagtcccgataagcatttcgaatctttccaatatatccaccaccatgaagctgtaaaacaacttctcggttctccatcaataatctctcggccgtatctacctgttcagaatcccccgcattgtcttctatctgatgcaacaataattccattgaaaaattcgacatctcaatcggcactagcgaaaaccctcttggcggatgccatgctggttccatatctgccactctctttcgtaatgttccgtcctgaatcaacggaccgattccatgaagagaagtcgcaagcgcgattacattctttgacactgccgccgccagactgattgacttttgctttctgcgtcttttacgcatcgcccgttcccgtcgaagcatctgttccattgccggcttgtccacagtctttcctcttcttctgatacttgtccccaaatctcttctgctcattcacatctcctgttcatttactattttatgataaactataaattcaaatttcaaacatgctatatatgcagctttctttttaattcattctttgccttacggtctccgatgagcatcgttccactccataaaagtacagacagccccagtgcgatccaggcaagtacaatatgatgaaaataccctttaaaatgtaatacaacatccacgatacttaaagcaatcgctgccagctgcatcaaaagataattctgccagcttgaggaattaacactcatacatatgataatcgcaagaaccagaccgtaaataatacatggtaagccaaattcaagtgaccaccctttccagtcaagggaatagtcaatcagcaccagcaatcccagtataacaaaaatctgtgtataaatctttcggatatgcccctgtcttctgctgaaaatatcccaaagagtcaggatcagatacgcaatgattccccctgttacaaccgaccagtactttggggcagcatcgaaggtcagataattgataaatgcaagaagcatctccaccgccagcgaaataaataaaagaattcttcctgcttttcgaaaacgtcttgtattctttttcacatccggataacccggtctctgcactccctgcattttatttgcgttatgatccaaactttgttccatcgatttattttctgtcagaatcgtgtggcagagcgggcacaccatcgtatcatctgcaacccatacattacatcttttacatttattcatgggaaaacgcacctcccatcaaaaaacagtttttatcaatcataatacaccccattcgtttcaatctccacttcaataccatcctccacaagactgcggaaaaatactttctgtacagatgtatcttttaagagagaactaaatgtaaatgtcagctcatccccataagaacagaccgttgcttttgtattctgcccgacagaaggcgataatatgatctgaaaacgtttaatatatggttcatatgctttatctactaccattcttcccatatttgtaatcgttgttgttgttgccttggcactcgttaaatatacaaactttattgccggttttttcaaaaaaagaggtacgacccgcaatgcataattcttctgattcgacacattataggcaatcatcctttccagattttcctgcgttatctgctttttcaactctttctgcacaagcttcatgacttcctgccgcccatatttttccttttccggtaaaaaggcagcactcgccatcgcaaaaaagtttctcgttgtcatcgactcaaaaaacggccgcaaattcactggaacacaaagtacaatcggctttttcgaaatattttcatgcaaatatcccttataaatgctgtatacaaaaatgccagataaatattcattaatactcattccaagctcttttgccttctctttaagctgcttcactgacatatacccatgaatagtccctagttcacctcgaacaagacgttctcccttcatatgcactgccggaacagacttataagtcttcttccctgcctttttataattctttaaataactgtcctccgtatcaagcgacgtatcatcacaaagccggtcacccatctcacccgaaagctgcggataacaaatcctcaaatactgatatgtcagttctcttaaaaaattcactgcacccattccatctgcaagcgcatgaaatacttccaaattaattctgtttttataataagtaacacgaaaaagataatttctattctcatgacgttccacataacgacaagggaaatcctgttcttcccgcacaacaggcttcccttttgtatttgtttcaaaataataccagaacattcctgttcgcatccggacgttcatcgtattaaaccagggcaaaacctgctctaacgcctcctgcaaacactccggacggatatctttagaaagaatcaccgcaattcgatatacatttgtcatcgtctcattcgcgataaccggaaaaagattcgccgtattatcaagcttctcccaacgcatttcttttttctgaaccctgcttttcatctctatcttatactcctgtctgtatgatattcttcacgcagttttttcaagaatgcctcggcattcttgctgcgagatgcgcgtcatgcaatgcatgacgcgcatctctgcaagtctacactccatttcggtcggcgcaaaaccattgtccaccggacaatgtgcgccctgccggaggctatatcagatgggagattgactcccccactgatactgatttgttgctcgccacctacagaggtgggagtaatctcacatctgatatatatattaacacaaaatgttgtattcttccccaaatctttgaattaattttgtcggattggaataaacagaacaccggcaatgtaaatagatataaattgtgacttggagcaagctcttaatgcagttgagcattaagagtacagtgatacagaactatttatatctatttacattgccggtgttcgtctactttacaaccttacaaaattaatctataatctctttcaccctctccacactgatttctgctatcgctgctatctgctctaaggggaactctgcctcatgcattttagtaactactctaactaatttttgtttttctcctttttcttgcccctctctgtagccgtattcctgtccctcttcaaatgcttcttccctaatcccctgacttaaattacacatttccttcacatcctttcttatatcattctccaatgggatatcgtattctttctctattatatccaatttgtcctttacttccaaatctgaagataaaagtgctgataataaacgatgtaattcgtatttttcttctttttccggtaagttttttgcgattcctatcattatgatatttagaagattcaaatcgcctttccatttatgagaaccaataatctgctcttcttttaaatgaatatgacttaagctatgttctttcatgttcatacatatccaaatagaataaactcttttcatattatcatattctgaatttacaaaatctcttcctttctgtgaagatactattctgcatatatagaaaatagctctatttaatatcttatattcacccggttcttctttttgtgcctctatgttaataattatctgtgtcagaccttctttcattctgacataaaagataatatcaaaacgtatcattccctcgttaatctcactgttttctgtatttaacccaataacctgttctgtggttttcgtatcttcttctaattcttttccagatttagctcgcttttctccctctttctttttcacattagtcattcctgaatcaaccggaactacactaatatatggttctccttctatataattaactacttccttcggattcattccccgaaattcctctatagtatttaccaatatgtacgccagtatgattttatgtcctaaaagcttcttagccttctcgtcatactgcgcatctttatctgacgctctcactgttcccttaatagatgcgtccacaaatacctcctttttgtaattagctattcttttattccatatttttactatataacatttttctgatctatgcaagaggaagtttaatttgtaagtctatgaaaacggcgaagtcagtgattatgaagacagaacagataacatattccagaattctaatttttcctgtcaccatccccaaatctttgaattaattttgtcggattggaataaacagaacaccagcaatgtaaatagatataaattgtgacttggagcaagctcttaatgcggttaagcatccccaaatcttccaactgatttgccgagctgccaacaaacagaaccccagaagataaataaagcatatttgtggcctcagagcaagtgttggatatgagcgcaaaagcgaacattcaacacgccgcgactaaagtcacaaatatgctttatttatcttctggggttcgtctgcctcgcagcctcacaaatcaccctctcttatgtgcttttccataaaagagttcggctaatttcccggttgtcatttcttctcgttcttttccggtcaaatccataactatttttccggaatcaagcatgatcgtcctgctgccgtattccagagcatattccatatcatgcgtaatcatcaacgtagtaattttattttcctcaacgatttttttcgttaatgccataactttttcggctgcaccaggatcaagcgcagcggtatgttcatcaagtaataaaagttccggctccgcaatcgttgccataagaagagatgctgcctggcgctgtcctccggaaagaagtccaattttcgttttcatcctgtcttcaagccccattccaagggtggaaagaacttctctgaaataggagctgtcttttttatttaaggcaaagaaagatggggaagcctttcttgtgtaagcaagggcaaggttttcctcaatggtgaggttcggagctgttccacgaagtggattctggtaaaggcatccgatgtttaaggcacgtttgtagtcttttaatttcgtaatgtctttatcccctaagtatacttttccttcatctgggaaaaggcttccgagaataacattaaacatcgttgattttccggaaccgtttgaacctaaaacagtaacaaactgccccggctctactgtaagattcaaatgatcaagggcaactttttcattgacagtgtttgcctcaaacttttttgtaatatccacaagctttaactgactactcatttgcgactgccccctttctttttataattcttctgcagccatgggataactaatgcgatcacaacgataactgctgataataatttgactgcataacttggcatatcaattttataagcaagctgaatgataatgcggtatagcaatgaaccaagaacaacaccaactgcctgcactgtcactgaatgggttccaaagaatgtaagaccgatgattactgaggcaagccccataacaagcataccatttccacagtttaaatctgcgtatttctgatactggcaaagcaatgctccggaaaatgcaactagcgcattggagatcattacgccgccaatccttgacacgtctgcattgatcgaggaggaacgaaccatctcttcattatcacctgtcgcaataatagccataccatttcttgtacggaaaaatgtaacaagtaccgcacaggttacaactacaataatcattgtaagtaaaaatgcaaccatactggaagacatattttgcccaaatgctctctgaaacatcttgtatacagtatctgccggtttatttactgtaaccccaaggctgttctttgtctcatactgtaaataacgattagactgtccgcctaaaatggcataatttactgtatacaaaccggtcattgtaagaataccagataaaatcggttctatttttaactttgtctgtaaaagtcctgtgcaaagccctgccgccgcaccggcaagtgtaccagcaataagtcctaaaatcggatgacctgcgattgaaatgataacacaggaggtcattccaaatacgaaactcccttccacagtaaggtcgggagtttttaaaatactaaatgtcaggaaaacacccagggccataggggcataaataaacccctggccgagagcggaaactaacatacctgctatttcactcatgtttctatcctcaattctaattatgtttcataatttttcatcatatgcattcgattatttattaaaatggcttgttccgtcttcttctacaagtacatcaaatccttcaaatgcctttttatcaaagtttccgccaaactgttttactgcctgcatatttacgtatttggcgtaatcagaaattgtctcataaggaatatcggaaggcttctccccatttgcaattttttctaccatgtcagcaacctgttttccaagctgtacataatttacaccaactgttgcaaatccaccatctgcaaccatggaatctgcaccacagtaaatagggatcttctttgcataagcagcatctgtatatgttgccattgcggaagcgattgtattatcattaccggtataaagagcatctactcctttggaaatcagagattctacagctgtctgaagttcagaaacattagcaatagaggactcttcataagcgatcttattatcatcacagtatttctttgctgctgtaattgttgatacggagtttgtttcactggatgtatacaggaagccaatcttcttataatccggctggaagttcgagatcagcttaacaatttcatctgctggaatattgttagaaacacctgtgatgttcgcacaatcttctcctgtaagacctgctgcttccggatcagaaactgctgcaaatacgatcggggtatcttctccatcataaacactctttgctgtctgcgcggtagaagttgcgataggaacaacaatatcaacgccatctgatttatagttttcaatgatagagcttaatgcagtagtatccccatttgcattatccgttactactttaatattctcatcttttccaagttcagaagtaatcgtatcacgaatctgatcaagggaagtatgtgacatcggctgtacaactgccaccgtaacctgctttcctgacttgcttcctgtacttccttctgcactcttatcagagccacatcctgttaaacaaagcgtaccaaccattgctgccataatcactgcacttacaaatcttttcatctttctcattttcttttcctttctatatctgttgtccgaagttttttatcagagtgccagcaattctaagttctaatcttgacttgccatttcaatatgttgctttataatctcgcaagatctattaagcatttcctgctcttcttctgtcagtggaagttctataatcttctcaattccattctttccgatgaggcaaggaacaccgcagtgtacatcatattgtccgtattcaccctgaagaagaacggaagcaggcatgatttttttctcatcgcggaggatacaggctgccatttcagttaaagctctgccgataccgaattccgttgactttttgccttcgatgatcgtcattccaatctgccttgttgcttctaaaactttctcctttgaaatgttataatcatcaaatggaattcctccgattcttactgtcgaaaatggaatcatagaagaatctccatgctctccaagtgaaaaagcctgaatggaatgccttgatacaccggattcttcactgagtgtccgaatcagtcttgctgtatcaagcaaagttcctgtgccaaatactttgtttcgctctaatccaagcccctttcttacaaaatccgctacaatatccgccggatttgtaatcgtcacaacaattcctgaaatcttgtaaggactaagctgtgcaagcagctcttttagcatttccaccgaacgccctaacatatcaagtcttgtctgccccggctttctcgcctctccgattgctataacaacaatcgctgcatcttcacaatccttataatctccgcttctgaccactgtctccctctcacagaaactaacactatctgcaatatcaagtgcctgtgcatatgccttatctttatccacatctacaagaacaatctcatctgttatccccgaatgtgccaatgtatatccacagtgggaaccgacatgtccggctccgataatcacaacctttcgcattttcatcctccttatccacaattatcaaaacatactcatacagccttttcattcctcaccattatagaaataggaattttttacagaaacgtaatctcctgaaagagataggagtcttctcgactgagataaaaaaacgtccctgacaaatattctctatctgtcaaggacgggtaaaattctaaaacttctcccgcggtaccaccttgcttcatgaaactcttcatgcactcacaggatacgcatcatatccctgacaactaacgtatgtcttcacgtcactgctaataagcaggtatcctgccgttcacactgccctccatggcccacttgacaatctgcgttctgtccggttctcagcatcccggtctctctgtaagtgcatcaatcgccctaacttccacatcatcggtttaattaaatgtccgctgtattcgttttttaagatgagttgattatatacccatatactagggaaagtcaactattgatttgctaatacttttaatcgtgcatcaatgtttctcttaatatctctaagagattccggatcgtcaatttcctttaataactttttataaatattcattttctcttccggcttcatatgtccaagaactttacgagtcagatactgttctcttgtcattgtcggtttaaatgtgcgggcataattcttagttgttttcttaaagcctaccacttcaataaacttcttctcaagtaatgcatttaccaataaatgaaccgaactgttcttccactccttatccccggatactttaataatttctgttgcggtaagagcgtcctcctgatcccacattacttccataatggctaattcactttttgtcagatgttctaccataataaatatctctccttaaaatttttatatatgcacgttattacgtttcatatagttttcctatctatcattttattgattccctttttgcttctttttctttgaaacgactgctaatagaatccatatgataattcctgctgcagatgccatcattccaagatgtaagcccggtgaattataacgaagtaccactttatgagaacctttcgttaaattaattcccatatacatcgtattcgctctgaaaacagaagtttcttttccatccacgtatgctttccagccagaagaatacggaatagagaataccataaccttatcagaagaaagggttacatttccactgacctcattattcttatctgtcaagacattctgaagcgactcttcattcctctcctcaatctgtgaaacataatcatccattggaacatagcatacttttacatcactgtagttaatctttgccttgattggaatcgtaaagatcacatcttctgattctgaagtatcgctatatcccagattaataagatagctgtctcttccaagcgcataggtcaggtcattattacggagcacaatatttttctccatatcatctgtgctgattttcgccttaatacgcggtttctttgttgttactccgtcaagcatcagataagcttcatatccctttttcttttcatatgaaagagtcagtgtactttcttcttttttcgaacgaatcctgtcttccttcacaataacaccatccgtatcctttaccgtaaccgttccgtacttaatcttatccgaaacagacttgatatcacccttctcaagactctttacattctttgtatcaagaactgctgactcaagcatcacctgttgtttttcgatagcagacagcttctcatactcttcattatcaatatatttatcatacgtatatccgatagataacggataatcattcttgtaaattgtatatttatgggcttttgtactatactctttatacttagaaaatccatatgggagattctgcgtaaattcctttcggatcatataatatcgtacattagcaagtgcttctaacgccgtacgattatcaaacgaataaatacggtgcaccgcactgattcctatactgtccaaatccttatgatactttaccattcctttattgataacactattatacatggatacgccgttataatccagtaccagacctgtattttcaaattcatcatctgcagaagaagtatctacacgataaaaattatcatctgaaatatctgtaaagaacagatacggagaacgctcaaacttcacagaaatagaaccattatacataaaggtatctactacaccaccaatgtcatatagcattcttccatgtactgctaaagatactactataaataccatcatcgctgtataatactgcatctttgttatcttcttcatacagttgataagtaaaataagcagcactgctccaactagcattcggaatgttgtctctgattccattacattatcttcaatcatatatttacagatcggataatatgccactgttacaacacaaagtataattacctgtattttagaaagacttcgcagatcatcaaacacaagaaccatcatataagataacgtaaatgtcacaatataaacccagcgattactgatcgtactaaatccagacatggcaaatgcacaaaatggaactagtaatgcaatatattctaatataataattcccttcagtcctctttctcccttcttcttattaaggaaaaagacaaccagcgccggtaccataagcgccacaaaaccaaggcaactgtcatactccggcacatacgaattcgatatcaatcctgccaatatctttcccggtctttggatataataaaacaacagattatctgtagcaattttggcattgctcaacccaactctgtcagaatttaacgttcttacaatcgtaggcaggaaagagactgctcccatacagcatcccagcaaatacgataaaataatccgtaccatcatggtaaagaattctttaactttgtcttttttataagtctgtgcaaaacggataagtgcatatactcccattgctacggtattgatatataaaaaatagtagtttgtaaacatggaaatacctacaaacaaaccgtacatcaacacttttctatctgtaatcagacggtctaatgcaattaaaagcattggcagataaatcagcggcgctgtaaaaataggatgtctgattccaagacacataatgtatccactaaatatatatacataagaaacaatacaggtagaaacccatggtttctttctgtaacggcagtatgcagtaaatgcaagtcctgccagatagtaacgtaataccataaggaaattataaaaaacttccatataacggtctggtacgaataccccaaggaaattcgttggatatgttcttacgacagaacgaaggtcttctcccattcctatcgtaaaatcatacattttcaagttaaagtccccatgtagcatacttactacagattctctcaagaactttgacatatattttaaatatgggaaatactgtggcatcgcatcaatcttccacaccaatgctttattcgataagatcattgtagaaaaaacgataacaactaaaacaagaaaacctccggtataacagatcatataacaaagaagtgggtgttttttcgcaaatgcccccaccttctgtttccataaaggttcctctttctttaaggaaaccggctgagccttcacacgttcctgtactcttttatacacaagataaaaaccggcataataaaaaatgccaaacaccaaaataccaagaatcgtaaaattttttccgcctataacaagttctgtaagtgctgctcttttccagacaaataagattaccgcactgaccacagatattccggcactaatcagcatactcttctgcttttccacgccctttttcaaaaggcccgctgccggaatctccagtgcgaatataacagccgcacataaaaacagtcctgcaatcggcgcaaccttctgcatggtaatcgtctctaccagtgacaacgtaaaccctttatggccggtaatcatctgtatgcaaaaaccacttccgaaatacatcataagaaatgtaaggaaaatccacataagcttttcttcccgctgttccctgtctggaaactttacaaagagcttaccggaaaaagcacctacacaaaaaaacgtaattacaattagtatactgtacattcctaacttaaccattctcttctccctcaaagttatttttattttcttataacaaaaagatttctccacttttttcttaaaaaagctacctataactatcaaaaaacaaaaaaattattttttatgaacagatacaactgttttattatataatcaaatatatttgccgtcaagaaagggtagaaattcattactccttctctatacaattattgttatttttgctataatgatgagaaggtatgccgttttacttcataccgtaactgctaaccacttattttattttaatttaaagaaggaatttttatgattaattttaatattcccccgtttacgggaaaggaaacagaatacatggcaaaagcaatccagaaccacaagatcagtggagatggagaattcactaagaagtgtaacaagtggattgaagaccataccggaacagcgaaggctcttctgacaacttcctgtacacacgctacagaaatggctgctctccttgcagatatcaaacctggggatgaagtcattatgccatcctacacctttgtatctaccgcagatgcttttgttcttcgtggtgctactgccgtctttgtagatatccgtccggatacaatgaacatcgatgagaatttaattgaggatgctatcacagagaagaccagagcaatcgttcctgttcactatgccggcgttgcctgcgagatggacacgatcatggatatcgctaagcgccataatcttctcgtaatcgaagatgctgcacagggcgttatgtcctcttataaaggacaggctttaggctccatcggtgattacggctgtttcagtttccacgaaacaaagaactacagcatgggagaaggtggctgccttttaatccgcgataaagagaatattgacaatgcggaaatcattcgtgaaaaaggtacaaaccgaagtaagttcttccgcggtcagattgataaatatacatgggtagaagcgggttcctcctacctgccaagtgatatgaatgccgcttatctctacgcgcagttagaaatggccgatgagatttacgataaccgtatgcatacatggaatacttactatgagaaccttacttctttaaaagaagccggacacattgaacttccatttattccagaaggctgtgtccacaatgcgcatatgttctacatcaaggcgaaaactcttgaagaacgtaccgctttgatccagtacttaaaagagaacgacatctcttccgtattccactacattcctcttcatggagcacctgccggacagaaatacggtcgtttccatggagaagataaatacacaacaaaagaaagcgaacgtctccttcgtcttcctctttattatggattagaagaagaaaaagttcttactgtatgtgaaaagattaaagaattttattcaaaataaatgtacttcaggaatcttttgagtacataataaactaccaggaggcaaaattcgtgttacactcgattatcataccctgctataaatcttcacagaccattcgtgaagtagtcgaactgaccagtgcggagctagatcgtttgggtcgtccggactatgaatttattctcgtagacgactattctccagacgatggcgcaacactgaaagaacttcgttctcttgctgccgactatccttttgtaaaagcaatttctttagcaaagaattccggacagcataatgctgttatggcaggacttaactatgcacagggagatctgctgatcgcgatggatgatgatatgcagactcacccttcccagcttcattttctgctggaagaaattgaaaaaggctacgatattgtttacggatactatcccgataaaaagcattccacattccgcaactttggaagttttttaaattacatcactgttcggatccttatcggaaagccaaaagatatgaagacatccagctactgggttatccgcaagttcgtaagagactacgttatccagtaccagagtccatacacacatttacagggactcttcttacgtactacccgaaacataagctgcgttccgatcaaacattttgagcgagaagtcggtcagtccggttacacattaaagaagctcatccagctgtattctaacattatgggctactctgttgttcctttacgactgtccacctactgcggatacttcttttctattttaagtatccttggcgcacttattatcgtaatccgtaaactcgtcaaccctatgatggctctcggatggccttccatgatgtgtgccatctgtttcttctccggtcttatcatgttattcatgggaacaatcggagaataccttgggcgcatgttccttggaatgaacaaacagccacagttcgttgtacgggaagtaatttcacaaaacagcactgctgcagcaatccaggacacagcaaatactcctgataaagtaacaactgtgaaacctgtacttccaacagaaactatttctgcaaagaacagctgcgaaccatcagataatgaatagataacgaagaaataacgaagactatatcatcataaatgtactctcggaatctttttgtgcttgatcttgtgagaagattttttgtcagttgtgcccaaatttctgaggcgtacgcggtgcgtacgttgatgaaatttgggtgcgactagcggaaaatcagccacaaaatcaagtgtaagaaagactccgagagtacatcataatcaatcaggaggtcatcatgaagaaaattatgattctcggagccggtatctatcaggttcctttaattaaaacagcaaaaagaatgggattatatacgattgttgtcagcattcctggaaactatccaggatttgctttagccgataaagtatattatgaaaataccgtagatgatgaaaagattcttgagattgcaagagcagaacagattgacggaatcgttacaaccggtaccgatgtatgcgttatcactatcggaaaagtatgcgatgccatgggacttgccggactttcctataaagccgcacagattgcagtagataagatgctcatgaaaaccaaatacgaagaatacggtgtacgtactgcccgcttccgccaggttctcttcacagatccagatattaaaaagacaatcgagggactggaattcccactgatcttcaagtctgtagactcctcaggtagccgcggaatcactcgtgtagattcctatgaagaatttgactctgctatgcagtatgtaaaagaaaacacaagaaaagactacttcttaatcgaagaatttgtagaaggcgaagaatttggagcacaggcattcgtatacaacggagaagtacagtttatcctccctcatggagattacgttttccacggagacaccggcgtaccaatcggacactttgcaccatataacttaaacaaagatgtcatcgaagatgccaaagcacagcttcgcggcgcagtaaaagcaatgcagcttgacaactgtgctatcaatgccgatttcatcttaaaagacaacaaaacttacgtcttagaactcggcggacgctgcggcgctacctgccttgctgagctaacatctatttactacggatttgattactacgaaaagattttaaaaactgctcttggcgaagatcctgccttcacatttgacaaaccatttgtaccaaatgccagccatcttctcatgagtgataaagacggaatcatcaagtcccaaacagaccacaatgaaccaaatgataatatttatgaagttgaattcgattatcagccgggcgatgaagtacataagttccacgtaggaccacatcgtatcggacatatcatcaccaaaggagaaaccttagaagatgcccagaaactgctcttcgaagctatggataaagtagagattgtagtagagtagaagatgataagcaaaaaagaaggaatgattttgtgttttcattttgttccgttgcgctaaacgcttcttttttgctctatccgtaatacctacctcgatttatcaaaggtacatggtaaaaataccggtaaaaatcatccctccaatttatcaaagtcagaaaataaatacgaaaataaaaaaaacaatagcatagatctgtaatgtcggagcaagaacaaatgccaaacaggcatttggctcgcagtgactatctttacagatctatgccattgttttttactttcgtatttattttcgtctttactttcgttttttaaacattttcaatactgctgccatctgttttcttaacgcgattgcagctgccactaccacaagaatcaatacagcatatcggaaataccatgctgttttgtaaagattcatagacaacaggttgatcgcaccgtataccactgcgataagaagcgttttacgaagtggaacgataaccattcctgtaattttatgctcaagaattccctgcacgagcagaagtatgatataactgaacgctgtcgtataggcagccgccatataaccaaaattcaggatacatacataatttaaaataacatttaataccatcgttccaattgttccagctgctacatactgggttctcttgtaataattctggagagcagaatagctgtaactatagaaacggaacaaggttccggataccattggagcaatgagccatactgccggcctgtactttgccggaccaagaatggcgattgcttccggagcgagcataacgatcacccaggaaagaattccaaacatatgcataaccgatgtccatggttttgcaacttctttttcttccccctgtgatattttagcataaagccatggaatccatgcattccatactgaatcctcaagaatccatatgataaaagaaatcgttgtcgcaagtgcaaagattcctgccgcttcattgctgatcattttctgaatcataatcttgtctgactgattcataatctgaatcgacaatgcttccggtataagcggaaggctgaatgccagtccatatttccaatattttaaattgataaacttcttaccctgtgtccagataacaatagcaacaatcgcccctccgataatctgtggaacatagtagccgatcacacgccgatcaacaagctgatcaataagtccctgcacccggcctcggtagataagccagatagaaaggaaggttcccggcacaatcgtaagcaaggtcgccatcgtactaaacttatatttaagaacctgtttatctcttcgctgtacatagagcatacttgtataagtaaatacatagaggaaacaggaataaaacatcaaatcatccatctggcagaagtcctgtacctgcgtcttaaagatcatgcagattccaaagaaaaatgcaatcgcgatgtaagataatgtatgcacgcttgatacatacccattataatcctcttcaaaatcattctttgctacatccacacttctccaaagacataatgacatgaccgtatatgcaatcagtaaccaggattcgtacgtacg

SEQ ID NO: 440 - DNA, 26094 bp, Eubacterium hallii
gcttcatctgattgcggtaatctgcggctgatttcccggaagattccagaaacgcttctaagtcctccacagtggaaagccccttttgccggagataggacagggcttcgctgactgcctttaagtcctgtgaagttccccggttctgtccagcccttgtccagtccttccgttcttcctttcgtatctccatatacttcatcagcagattgggaagaagtgtcgcttcctccgccgccttttgtgcaagcagctccttccgtttttctcccagctcggtaatccagcctttgaggttttggataagctgccggatggacttcatcaggcggttggcggctctgatttcccggttcaggttgccgatattcgtctggatacctcgcttttccatctgccggacagcagtcccctcatggacagtggggactatatcaagcccctgtctggcataggaacgcaagtccacacgctccgggcggtcattggcgtccagatagcggttctggataacctcccattcatgccgccagatttcacaatacttctggtcgttccagtccaccgtatcctccttgtggcttttccacctgccggacggcagctttatccgttccccattctcgtcaaggtcataaaccttgcggctcttgggaagccattttccatgttcatccattgcccgcatggtcagcaggacatgggcgtggggattgtgtcccggcggatgggggtcatggatggcaaaatcagcaatcatgcctttggaaacaaactgctgttcacaaaactcccgtacaaggacagcgtactggtcgggcggtatctctctgggaatggtaagcacccaccgccttgcaagctgggagttccattgcttttccaccgcttcggcggcattccataaagtattgcggtctgcatattcctgtggagcatttgccgggagcaggatttcattgtggacgataccacgcttttccgggtagtgctttacttgctggtcgtattcacagaacagcttttcgccgctttggtaagcagcggcggcaaccgcagactgccgctggctgcgctgaacaatcgtgatttcgttgtgtggacaaggcatttcgtgtccctcctttcgctaattggtggatggggtggcgttttaccacctcattttgggcagaaaaaaagcaggagacctttttcagatttcctgctcggtgtgccactgtgtgagcggcgggtatttagttgtaaaagttcgggacaagttgacccgatgtaaagctaacaaactggaattgcaccaaaacaatctaagacaacaacgctgccctacttgcgattttttcttgtactgcggaaacagtttcttgaatggaataagtggtcgtatctataacattcgattcatatattcccagattgcaaaattgctcccacatggtttctaccaattcgatatttgtctttcggtctaactttgagcgttcaacagctcgcttcaaggtttcttccttacttgcccttaaaataatataatgcacctcataatgttcccgaacaagactttgccacggctttaaaaaccacggtccgataataccgtcaacaattacatcatatccaccacgagcatatcgcttcgcagcttctaaaaacgcttcaatgacaatcaaattttgctcatttgattctggcaaatgcggtggtattgcccctttactcaaataatgataaaagtcatctgtgtgcatatgcacagacttttccaaatctgattcttttgcaacagcagatgccgttgtagtttttcctgtccccggcgcacctgtgattacaataattctaccttgattcatctatattttacctccacaaattacgattttcttaattctacaaactggaatttgagtctctgtaaagctggaattaacccatacaattattttaatttagaggttcttacgcaattatccgtattttgtaatttttcaatactggaatgccagtgtaaatcagcattctccatttttattaaagcgaaaaacgtaaaattgcggaagaaccaatttagatattcacaattttacttgccacagtatctcgaaaaacactgtcatgttctaccaggagcatggtcggggcaaactccgttatgagttgttcaatctgcatacgtgagtacacatcaataaagttgagcggttcatcccatacatacaagtgtgccttttcacaaaggcttttcgcaattaggactttcttcttttgcccgccagaaaagtctttaatatccttttcaaactgtacacgctcaaagtccattttcctaagaattgccttgaacaaactttcatcaaggttgttttcttctgcaaactcggaaagggttccacataaatacgatgtatcctgtggcacataagaaattacaagcccagagccaagtgttactgtacccgtataatctatggactgcccgactaccaactttaacaggctacttttgccactgccgttctttccatcaagcacaatgcgttctccctgtcttatttcaaacgaaacgggttcacaaactgaaatgccatcataataaactactacattcgataatgatgcaagcaaatctgtatggtaattaagcggttgtatcttgagggcttctgcggtttccatatttttcagcaatgctgatttttgttcgattgtctgttgttgtctcgcttctatagattttgaacgcttcatcattttggcggctttatgaccgacataacctttatctgctgccccaattttggaagcttctacacgttcagaccatactgcagcgcgttttgccgactgctgtaatcgtctgatgtccttttgcaaacgttcgttctgagccagttcaaattcttgctgtcgctcaaaatttgacatccatgatgaaaagtttcctctttgcacttcgatattcgctcggttaatcgatagaatatagtcaacacaatcgtcaagaaagcgacgatcgtgagaaactaagatgaatccctttttctttttcagatatgccgccacactttttctcgctttggcatccaaatggttggtaggttcatcaatcagtaggaaatgcccttcattaagaaaaagagcggcaatcaaaacctttgtctgctctccgttggaaagtgtttcaaaaggtcgccaaagcacatcgacatcaacatcaagataagaaagttctcgcataagttcccattcttccgcaagtgggcaaatctcctgcaatatatcctctgtaatacgattcttatctgaaacgggataaggaaaataatcaaactgtacggatgataggatttttccactatactcatatttcccaagcagaagattcagaaaggttgttttacctcgtccgtttctgcccacaaaaccaagcttccaatcggtatcaacctggaaactgacattttcaaaaacattatcataacttgtcggatatgaaaacgtaaggttttcaattttaatcattgacataaatattatcctcctttgcatgtcatacgatacaaagtcggttcggtgaatgtttactacgtatagatttcaccaaaaggaaccgacactatacggagtgaatcatgtgtaactatctgttctgcactattcataaagcacctccaaaacaaaataagagccacaagaaagtttatccttgcagctcgtcatagcataaaataacaccactaagcaaaagtggcaacagcactatattgagtaagatagacatataactttcttgcaatagacacaataatgccaaagtatagcactaccgcatattttgattttatttgcaagaaaagttaatcatcttcccacctctttctaaatttcaaaatattataccataaatcgcaggcaaatacaagtggttataaaaatttaacaaatcgcttataatacaatcatataactttacgcattccttactgaccgtaaaattccgatttattgctgactttattatactttattgcctatcgaaaagatagcatattttatgaaacttgtcggctgggaacagcttgcaacgcaaggtgtccccagatgacaagtccacaaaagggtagctggcggtagccagcgcaggggaagcgtagcgtcccctgtatgatttggagcagaccatgactgcgaaaaatcacagccctccggcaaggagccttcggagaacgcaatgcaccaacctttgggtggtgtataattgcgcccttagtaaactaaggggtttccggcttctcacgttccagcagtttcttcaatagttcctgcgtgtcctgcctgtgaaaaatgagtgtcaacaacagcatgacatcatcatctgtcaggcgttccggctcttgcagaaaactttccagcataccgccacgagtacagagccggtgtgtccgttcttttcgggtaagctgctttagctggtgctgcaatgccttttcatcattgatggctttccgcagtttcttttcactcttttccaactctcggttgagcttttccagctttgaggtatcaggcaagggcagcgtcctcctttcccggtatcagcacataaatcctgtttggttctccaacgccctgacgcactcgcatgatcagtccggcggtttccagttcattcagagaacgcttgaccgtcatggggctgcgggacaggactgcggcaatggctgtgacagggaagcagataaacaggattccgttctcgtcctcctgtccgttggatagcatagcgtccaacatccggcagtacatgacctttgcggtgctgctgactggaaatcctgtcaacgctctgggaaagggcatacagggcggcaacggtgtgcctatcgtcataaattcaaaattcattcggtgtgttcctcctttttctttgctcttttggataaataacgggggcagtcaaccacaaccgcccggaagctctgcttgcacccatgcttgcatttccggcataattcgttgtaagtgacacgcccccggtcattgaggtaaaaagaaagctcatgcttcctctttttgctcattctcggcatattgcgtttcctcccgttttagtgtatagtttcggggcgattttcggcaaaattacggtcatagagccgtctaaaatctccagaagtatcagcaatagggtagactatccccctatcagattgtcgtgtttcggtatcatttcggtatcagttcgccagttctccccggtgtcgttcctcccctgaatctcacagcggcgtattgctccctttggtacgctcgtttcggtcagggttcctccatatccctgccaaaagtcatggcgctacatcgccggggaagcatatcccacacaggctggtcattcgattggaataatccatcgatgaactacctgtatcatagaacatttttgtgccctgtgccgtatgtccacaaagtaggaattaagggtaaaaatcagaaatttccacgattgcggaaagtatgatataatccagttaagcggcagtaatgaaaccgccggaaaggagcgtgcgcccatgaaaggagcgacaagcatacaggaacgcctttgggaactccgcaaggacaaaggcttaaatctggaagaattatcagagctgacgggcatttccaaatcagctcttggcagttatgaaaaagaggattataaggaaatcaatcatggcaaccttatcacgctggcagacttctatggggtttccgttgattatctgctgtgccggacagagaaccgggagcagatcaacacgccactaacagagctgcatttgaatgatgagatggtggcacttctgaaaggcggtcggattaacaaccgtctgctctgtgagcttgccactcataaggactttatcaagtttcttgcggacattgagatttatgtagatgggattgccaccatgcagattcaaaacctcaacgcccttgtcgatactgtccggcatgaaatcattgaacggtatcgccccggcgaagacgacccgcatttgaaagtgctgcaagccgcccatatcagcgatgatgaatatttcagccacatggttcttgatgacctcaatctcattatccgggatattcgggaagcccacaaaaaggacagcgagagtgcgccccagaccaccgttgccgatgaattgaaagaaaatttggaagcggttgaaaatttcaagggcagtcgggatgaaaagctggttgtcctttactgcaagcagctcggcatcaactataaaaatctgtcagacgaagaatttcgctggctcattcggattctacaaaaatcaaagaaaacaggaactcctatcagtcaaaggaaaaaacggtaaagaaaaaccgctgttgcatggttgtgtttgcttccatgtagcagcggttggtgctatacttattcagttaaaatttcaaagcgataaagtggaatttatcttagaaattacagcaatgttattttgataaactttcaagaattgaaatatcatgcttatctttatctcttaattcataacctgaatggaaaactctttggccttttaaggatatacaaggaattgtttttccttcaaaaaaagcactaccaaagtaatctttttcaaactcataccagccaccctctaaatcagcttgttttgaagttccgtcctcacttaaaacgaacgggtgaatgtctaagtaaccaagttcatcactatataactctattctaaccggtttccagtctgtatcaattttatagcccagattcaaaagcacatttaacaatttttccgtatgttgagcatcaaaatttatatctatatctctatgaattcttgtttgtttaccagctaaaatatctacaccccatccgccatccaaccagtatgtaattccagtattttcgaataattctattactttcattaaatcttcttttgttgttatttcttttctacccatacaaagtctcctttacaacttctaatttgtaataatcattctaccataccgttatgaataaatcatctcatgtaaaacaatttcttctgcccggttgtgaatgttattgcaacgctgcacccattccatttgacgggtacgcttcaattcctcggtcacgccctcggcagctttcatctgctccatgatggtgtctaaccgtttctgtgcctgttcgttcaggtctgcaagatatgtccacaattccccggtcagggtcaatgtgtgtaatctggctgggcagacttctcttaaatattcccggtgcatccgtccgtactttccgatggggcggtgttcctccggcaacttcaagtccgggatgtagtaatctccaacaaggatataatcaattccgttttcttttattcttggtttcaattcgctcatgttccttacctcctgtggaagcaggctcgtctggtactaactcaatcacatcggtaatctcacaattcagcgtttcgcagatacgggctaatgtatccatgctgatgtgctttccctctttgctcatgttggcaatcatatttgttgtcataccagcggcaagccttaaatcctcttttctcatatcacgctctaacagtgtgtgccagagtggtttatagctgatgtgcatattgttttcctgcctttctatccataccaccggagcggctgccccggcaggaacttttctcttattatagcaccaatcttgtgaaatcacaatttattcttgtagcctgccgctgataccgtctggattggcttttcctttctttttgttccctttaattagccatgaactgcttaatgccctgtgattttgcgcccggattgtcgtttccatatccctctaagagattgataacgccccaaatgccaagtcctgctccaagagcgataaccaaagtctgtaatacgccgattgcgctgttgaaaaattccataaaactcctttctgccgcaaatgcggcttgccccgtaaaagggtataaaaaacggcggtcagttttcaaactgccgcggtcataagtccccgcgctgcgtaagtgtctgccgcgcggcggtattcagttgtcagtgtgggcgataggaatttttgtaggggcgcgtatcatgcaagttgtctttttctttgttactgcgtcaattcctcctttcttttcgctgctgctcatacagggcttcacaccgtttcacaaattgccggatagcagcctgccgctgctgttcccgtcgttcagcaatcgaaacaagcccgtttatggcttctgtgattttcttgtcctttttctttctgatacgtctattcatggtcggtgtcctcctgcaaatcgctttcgctgatttcgtagtagtcaaatacttcgtccggcttcacaagggcgggtctgcgccttaaatgcttttccatatcaaaagtatttttcttatcatagtcggaaagatatttatagttggggtgctttgtaatgtcgtacttatcggaaaagaacgggcgcacccctcgtagctgcaagatacatttcccgccgtccataaccgctatttcatcttccgtcataagctgcttgcctaacttctgatagttcagcccatgcgatacctcgcgcccccggttctcggaagtgttgaagctgtcaatggtttctttccccaagatttccgacatttctttgagggtggttttttccttgccgcccaagaaaagggtggtgtcgcagttgccgactatggtatcggcgttgtccttatagattgcctttaactggctttgcgactgtaagataatcgacgcggagatttcccggcttcgtatggtggctatgagcttttcaaacttcggtatctgcccgatatttgcaaattcgtctaacaaacagcgcacatggacgggcagcctgccgccgtattcatcatctgccttgtcgcaaaggagattgaaaagctgcgtgtaaagaatactcacgacaaagttaaaagtatcgtcggtgtcgctgatgataacaaacagggcggtcttgcggtcgcctatggtgtcaagctccatttcgtcggtttccataaggtcgcgcagctccttaatgtcaaaaggggcaagccgcgcaccgcaggaaatgaggatagagcttcgtgtctttcccgcagataacagaaatttcttgtactgccggacggcaaagtgttccgggtctttttcctccaaccgttcaaacatgaggtcaacgggggactgaaattccgggtcgtcctcgcgggcttcactggcatttatcatttcaagcagcgtcgtgaagttcttttcttcctccggggcttcgtaccaaatgtagccgataagggcgcagtaaaagagccgttccgattttacccaaaaatcctccccggctttttccccgtcccctttggtgttggcaatcaaggtatttaccagtttcaaaatgtctttttcgctgcggatataggcaaagggattgtagcgcatggatttcttaaagtttatcgtgttcagcacctttatccgatacccgccgcgctgtaagagcttcccacactcgactaaaaccgtacctttcgggtcagttacaacgtagcttgagtgcatttgcattaagttgggcttcacaaaaaatctcgtcttgccgctgccgcttcccccgataacaaggatatttttattccttgcatacttcggctgcttcgggcggctgttcatggtaagccgttctgtctgtgtcagcagcacgttattttgaaataccgggtcggtgtagggctttatatcttcggcgttgccccaacgggcagaaccgtattcgataccttttcggtatttctttgcgttcttgcctttgaagtacaccataagccggataaggacagcccccacaataccgataagcaaatccataggggcaaggctcggaagcgggtttgcaaaggcagcggaaaagccgtctgcaagggaaagcaccttgccggaaaggtcagcccccggcgcaaggcgtaccgcctgtccgattttgtcaaagagatagacaaagagcagatagggggcatttaggataagcagctttttgagttccggcttcatagcgatacctccctgtcctttttcttcactttgtctctctgtgcgttcagagctgccgccttatctttcaaagtggaaagcagcttgcggatagagggctttttatccctgcctaatttctttgcggtaaattcccgaaacgcttcggtcataacgtcaatatccttgcccttaaaagacacaaggtaggtcggcggcttgccgttttcaatcttcttgacgttgtaatcaagcccgttcttccttgcgatagggtcaaaggctttgatattctggtcggtaatctcaatgttggaaaccttttctcccggcttcataagctgccgcatagtgatttttccatgcggggctttggttagctgccctttgcctttggcaagcagggctttcatagccttttgcagcacttcggcggtcagcttagatgttttgattgctaaagatacgactttttcgttgacttcatcttgcatgaaatccctcctttcgtggttttgttagggtggtatgccgcttcggggcataaaaataaggcgtacatttttcatgccgcctttagatacgcacccgcagcccgttcaaatccgaagccctcacacccacaagataccagttgtccccgtactccatgcgggtcggcttccatttgccgcgtacaaacacttcaaagcaatccccacaatgcaatcctccgtagtagtcgttaaggtcaaagcgaatgtcgtaacggtctgccgtttcatcaaaaatcaaagctcctgttttctgtgccatattaaaatcctcctgtttttaatagccgccgtacatatcgtggttgacaagggcggtgtaatagctgtctatggtgttgggtgcgttgaaaagtaccgctttcagatattgcttgatgttgcggattttcgtggtgttctctttcatgcagtcaaagacaaattcaatgtggctgctgttgagcttcataaactttgctttgacaagctctgccggataatcgtccccggcgatacggattgtttttcgtttggtgcagacagtttcaaggataagggatacaatctcgtccaagcgttccctgtcaatgtcggtatgcttgataaaatgctcatactcgatattgtccttgatgatttcctcatacacactgtatgcgtctgccgcttccgttcctttccgttccggctctgccgtttcttccctcaaaggagaggggttaggggaaaggataggaatggaatggttatttgataaatccgtatttgatttttctttttttgataagttagtcttttgtatatctttatttaattgcattggattttccgacgtcgggttatccggtgtcggattttccaatatcgggttatccgctgttggattttccaataccggacaatccaatgccgggggctgtggctgttcgtaaatggtgtactcgatagcggtcattttacctttctcgtcgcgtccctgccgtcttgtgatatatccggctttttcaagctcccatacagcggtgcggatagcgtcgatactttcccggttgatataggacagtcctgcaagggtatagtcccaatcctccggcaaggacagcatttgtgataacagcccttttgcttttagggaaagctccttattgcgtaaatggtggttactcataaccgtatatcctgtgtttctctccacgcggaaaactgccatagcttcatcaactcctttgcttcatatttgttacgcagtagaacagcaattttgagggtttaggtatcaatcccttactgtgtgaaaaccgcacccgcaaagccttatgtagcaaagctctttttgcccctactgcgtaacatgagggtaaaaaaatagcggcgttccttgtttccctgttgggataaggtaacgccgcctgtgcggtacattataatattttaacttctgttctatcatgctatatggttctatccgtagaaatctgtatgcccatttatcaatacataaaatgcgttggactctggttttcgactatctttttacacccatttctacacccaaatggcatgaaagtatatgattttgtatgaagttttatgaatttacaatttcaaaaaactttgtaaccatgcggttttacggacttttattgatgtatatagatttatgaaaaaaggctaatttacaacaatacctaatttcataaaaattcctcctatgttgttttatgtactcttgtagcttttcctattctcaaatcccattaatgtgagtattacgtacacatcaaaaattctgccagtacattttagaaaatctggaaatcaagaatggaagtctttaggagtacatcttaaattcataatttcaatctattattctaacatagaaagcaagaaaaagacagaagttttactatagaattcggtgaaattcttttttcctttctctcctgtgaattaaattgaaaaatttctttgggagggatataataaataaaataataagaacaggaggttagtgaacggaagttatgcagtacacagatattcgatttccgcatcttggaattgttctttcccatgtgggaagatatatctccataggggattttcagattatgttttacggaattatcattgcatgcggatttcttgtcggtttgtgggtggcgcaacaggaggcaaaaagaacagggcagaatccggaaatttacatggattacctgcttgttatgatgattccggcgattattggtgcaagaatttattatgttgtattttcatgggattcttataaagacaatattccggagatatttaatttaaggcatggaggacttggaattgtaggaggcgtggctatggcggttcttgtcctttttctctttgcaaaagcaaaaaagcagagtgtgcttttaatgcttgatacgatgacaatgggactgcttatcggtcagatcatgggacgatggggaaactttttcaacagagaagcttttggaggttataccgacggaccacttgctatgcagattccgctaaagtattttgaacagtatggaagggtatcagaacttgagagttcaggaatccttaagcatcttgttacccttactgttcatggggagaagctgtcttatattcaggtacatcctacatttctttatgaaggaatgtggaatcttcttctgttgctttttatctttatttatcggaaacataagaagtttgatggagaacttttatgtatttatctgatgggatatggattgggacgtttctttattgagggacttcgagtggatcagctgcttatcggtcatacgggaatagcagttacacaggttgtatgtatttgtatttttgttggaggactgattgggatggttcttgggcatagaaagagtaaggcttgctaaagtcgcctgtttatgctataattccttaggtttttacaaaaaataagcaaaaagccaatgggctggaggatgttatgaagcgattttggaaggatttaaagagtcactatcgctacgccatttattctgcaaagtcagaattaaaatcagaggttgccaattcctacctgaactggatttggtgggtgttagaaccattctgctttatgctgatttatgcgtttatttttggcgttgtgtttaatgcaagcgaacagtatttcccggtatttatcttccttggtattaccgcctgggattttttcaaccgatgtctgacacagagtgtaaagcttttaaagaataataagtctattgtaacgaaggtatatataccaaagtttattttactcatatccaagatgttttttaatggatataagatgcttttttcttttgcgattatcgtgatcatggttatttatttcaggataccgattacgttgaatgtattatatgttattccgatatttatcgtgttgtttgtagtgacatttgcctgcatgacacatctgatgcattacggagtatttattcaggacttagcgaatgtaacgaatattgttcttcgtatggtattttatttgacgggtattttttataacattgaaaaaagattacctgcgaaatatacaggaatcctgatgaaaggaaatccgatggcacttgtgttaagcggtattagaaagtgcattttatatggtcaggcaccagatgtgaagtggctttttatatggtttattatcggtataattgttgctgcgttgggaattcgtaagatttataagaacgaaaacagctatgtaaaggtgatttaatggaagagaatagaaacagtgcaattagcgtaagaaatgtatgcattgattataagagtttaaagacaggttcaattaaagaaaacctgttcaaaataaaaaaagttgagcaggaaatattccatgcagtaagaaatgtttcttttgaagttccggaaggacagattcttggaattaccggaaagaacggtagcggaaagtcaacgatgctccgggcgattgccggaatcttttcggcagacagtggagagattgatcttcatggacataccatttcccttctgtcaatcggtgttggttttaaaaatgaactgtcaggaagagagaatattattttatctggtatgctccttggattctcaagagacttcattatggagaagatgccggaaattatagaatttgccggaattggcaactttattgatatgccggtaaaaacatattcaagtggtatgtattctaagcttgctttctcaattacagcgattcttgaaacagagattatgcttattgatgaggtacttagtgtaggtgaccagaagtttaagaagaagagttataataagatgaaggagctgatctctaaaagagatcgtacggtagttattgtttcacacagtatgtctacgttagaagatttatgtgaccagatcatctggatgcatgatggagaaatcgtaatgtatgataaaccggagattgtccttcctgtttatacagatttcatgagataagttaaatgttataagaataaataaatgtactctcggagtctttctcacaaaatcaagtacaaaaagattccgagagtacatataacagaaaaaggggaacggttgttttttgatagacaatcgttctttttctttagaattttgcaggtaaaacattgaaaataacactatatttatattgcattacagacagtgatgatataaaataaaatttaaatgggatacggaggtaaaaatggaatttgttcataaatcaatcatgctagaggaagtcattgagtctctggcaattaagccaaatggaatttatgtagatggaactttaggtggtgcaggacattcttctgaaattgcaaaaaggctggggccggaaggcagactgattgggattgaccaggatggagaggcgattgcagcggcaacaaagcggctggaaccgtataaggatcgagtaacgattgtcagaagcaattatgcacagatgtgtcaggtgcttaaagaactgggtatttccaaagtggatgggattcttcttgatcttggagtttcttcttatcagcttgataatgcagagcgtggttttacatatcgtgaagatgttccactggatatgcgtatggatcagcgtcagacgaagacggcaagggacattgtgaatgagtacagtgagatggaactgtatcatatgattcgtaattatggagaagataagtttgccaagaatattgccaagcatatcgttgcggcaagacaggaggcaccggtggaaacaacaggacagcttatcgagattataaaggcggctataccgaaaaaggtacgtgctacaggtggacatccggcaaagaagacttttcaggcaattcgtattgaactgaatcatgagctagatgtgttgaagaataatttagaagatatgatcgacattttagacgatgaaggaagaattgcgatcattacgttccattctttagaagaccgcattgtaaagaatatttttagaacctgtgaacgtccttgtatctgccctccggaatttccggtatgtgtatgcggaagagaatcaaaaggtaaggtaatcacaagaaagccgattgtgcctggaagagaagaattggaggagaacagccgctcgaaaagcgcaaagcttcgtgtttttgagcggagaattacaaaggaatagaatatgcatcataatcacaggagaagagatttccttttttatgagtgaagaatgaaggttggaggttagaatatggcgtttcgtgatacatcagaacgttacgagtatatttacggaagtaacgttaaaaagttagacagagaaactgcaggcagtacaaagtcaggcagtccaaagcgtgcagggaatactgctcgtaaatcagaatatgcagtggaacgaagcaaggcagtaagtgctcattcagaaacggcaattcagaagaatacagcccgatttctggcatttgactggaagtatacgctgattgctgtaatcgcagtagttttatgtgcttctgcggcaatgttttatctgcatggaaccgtacagttgaatgtaatggaaaagcagatttcagatttaaagacagagaaggcaacattactcagcaagcagaatgcaataaaagcagagattgataagtccattaatttagatgaaatcaaagaatatgcagaaaagaatttacatatgatctacccggaagattcaaacatactcctctataaaggagagtctaatgattatttcagacaatatgaaagtgtaaattcaggaaagtaaaaagcaggtggtaaagtggcgaagaaagtaaagaaaatcaaacgcctgactgaccagatgagaggtaagctgatattggtatttataggtatcatctgcctctttttcattttggcagtaaggcttacatattggacagtaaacaaaggcagtgaatttgagacaaaggtactcggacaacaaaagcatgatagctcggttattccttttgagcgtggaaagatttatgacagaaatgggaatattctggcaacaaatgaaaagatttatacactggtattagaaccaaagaatattctgcttcggaagaagaaatatgaagcgacaacaattaacgctttacatgaatactttggatttagtaaaaagaacttaaaaaaagtaatcgaagggaataaagattcctattatgtagtttataaaaagaatatgacctacgatgaagttgcaaagtttcagaagttccttgatatggcagatgattccatgaaaggggtatcggatactaaaaaggaaaagattgaaagcgccagacaagtaaaggggatttcttttgaagaagattataaaagaatttatccatataattctcttgcttgtcgtattttaggctttacatcttcaggcaatgtaggaaactggggaattgaacagtcttataatgaacagcttaatggagtgaatggacgtgcatactattattttaatgaggagttagatcaggaacagactgtaaaagaagcaaagaacggtaactccgtagtgagtacgattgatatgcagatccagaaaatcatagaagaaaagttaaatgattttgacagtaagattggaagtaaggtaacaaatattttagttatggatccacaaaatggtgagattttgggaatggcaagttcgaatccatatgatttaaatgagccgatggatgagaagaagctgttatctttatattctcagagtgagattgatgaaatgaaagcatatacccaagagaaagaagcagaagaagcttcagaagaggagtcaggagaagaatcctctgaagaaacaacggaacaggaagataaagatacagaaaagaaaaagacgatttatgatgcgttctatgaactctggagaaatgcaatcatcagtgatacaaacgagccgggatctacttataagccatttactgtagcgacaggattagaaagtggggcacttaccggaaatgaaagttatttttgtacaggttctcttatggtcggaaagcgtaacattggatgttctcatgtacatggaaatatcactttaaaagatgcagttgccaagtcctgtaatgttgctatgatgaatatcgcatttaatgaaggtgcagaaacattttataattatcagaatctttttggctttggacgaagcacaggaattgatcttccaggcgaggcagaaacaaagaatcttgtatataatgcctcgaattattccaatagtgtcacgcttgcaacgaatgcttttggtcagaacttcaactgtacgatgatgcagatggcagcaggtttttgttctctcattaatggaggaaattattaccggccacatatcgtaaaacagattcagaatgatggtggagatgtcgtaaaagatgttggaaaagaagtattaagaaagaccgtttccgaagaaacatcagcatcgatccgttcctatatgcaggaaacggtggagaacggaaccggtacgaaagcgcagattgaaggatatacaatcggaggaaagactggtaccgctgaaaagataccaagaaataaaaaagattattatgtttcttttattggatttactccggtagaaaagcccgagttactggtttatgtaacgattgatgaaccgaatgtatcatttcaggcgaatgcaggtttagcagtagaacttgagaagtcctgtatggaagaaatagtaaatgttcttggaattaaagcagcaacaagtactaaggaataagtttttgcgtatactgattaataaactatttctgaggtgagcgatatagagattcatttatttcagaaaagaaaatacaatcttgttttcttatgcttttttctggcatttttacttctgaccggacgattgatctatctaaccatttttcgctcagaagaattaagtaaaagagcattaagcattgagcaaagagaacgaacgataaaggcagcaagagggaaagtttatgacaggaatggagtagtgctggcggataatcaagcagtatgttctgtttctgtcatttactatcagataaaagaaccggaaaaagtaattcggcttttgtcacaaaagcttgcgatttctgaaaaagaagtaagaaaaaaggtagagaagatatcatcaagagaaaaaataaaaagtaatgtaccaaaagcgatcgcagatgagattcgggaagcgggactttccggggtcaaggtagatgaagattataagcgctactatccatttggcacactggcatctaaagtgttgggatttgcaggagcagataaccagggtattttagggttagagtcccgatatgattctacattaaaaggaacagatggaaagatacttacgatgacagattatcagggaatcgaagtggagaaccttgcggaggatcgaatcgagccggtaagtggagatgatctgtatctttcacttgattataatatacaatgttatgtacagcaggcagcgaagaaagttttaaaagcaaaaaaggccaaaagagtctctgctattttaatgaatccacaaaatggagaaatctatgctcttgtcagccttccagagtatgatttaaatgaaccgtttactttaattgaagaatataaagagcaaggaaagactcaaaatgataagttaaacaatatgtggagaaatcctgtgatcagcgattcctatgagcctggatcaacattcaaaatcgtaacagctacggcagcattagaggagaaaaaagtaactttacaggattcttttttctgttcaggatttaagcttgtggaggatagaaaaatacgctgccataaaacgcaggggcatggagcggaaacgtttcagcagggatttatgaattcctgtaatccggtttttatggaaatcggagcaagagtcggggcaaaagatatgctgaagtattatcagaagctggggctttacgaaagaacaggagtggatcttccgggagaggcaaactccattatgcataaacttagtaaaataggtgcggtagaacttgctacaatgtcatttgggcagtcaatacagattacacctttgcagctgcttcgggcagtaagcgcaggaattaatggaggaaagcttgtaatcccgcatctggcaatggaaaagaaggacagcattacgaaagaaataatacaatatgaatatcctataaagccgggtgcagtttcagaagaaacttcacagacattaagagaacttttggaagcagtagttgcggagggaacagggaagaacgggcaggttgagggatatcgtgtgggaggaaagactgcaacaagtgaaaaacttccgcggagaagcggaaagtatatttcctcttttctgggatttgctccggcagattctccaaagattctgggacttgtattgatcgatgaaccgcagggagtctattatggcggggtaattgcggctccggtcatggcagaaatttttcaaaatgtcctgccctatcttgataatctgtgaaaagaggattatactgtgtaagaatgtcttaaactacaatagataaaatggaggttaaattatggatcattcaattgcaataccagcattagttgcattttttattacattaatattaggaccgggactcatcagctttttacataagctgaagtttggtcagtttatcagagaagaaggaccagaatctcatctgaagaagtccggaacacctacaatgggtggaattttatttcttgttggaattttagtaggatgtgctttttatatcccggattataaaaggattattcctattttattcgttactcttggattcggactgattggattccttgatgattatatcaaagtagtaatgaagagaaatctcgggctgacaccggcacagaaaatgcttggacagattgtcattactgctgtttttgcattttatatggtgaaccattctggattaggaacagacgtaattcttccgttttcaggaggaaaagaatggcatctcggaattttatatattccggtgttattcgttgttgtgcttggaacagtgaatggggcgaactttacagatggacttgacggccttgccgcaagcgtgacaactttgatcgctgtatttttaacagtaatcgctgtaggaacaaatgcaggaatccatccggtaatctgtgcggttattggtgccttactgggattcttatgcttcaatacacatccggctaaagtatttatgggagatacaggttctctggcgcttggtggatttgtcgtatctacagcatatatgttaaagatcccactgtttattccaatcgttgcatttatttattttattgaggtactgtctgttatcattcaggtaacctactataaaaagaccaaaaagcgtattttcaagatggcgccgattcaccatcattttgagttatcaggatggccggagacaaaggttgtttctattttctcaattgtaacagcagtattatgtctgatcggtatgctcgcgtactaatttagaaggatagcatctgaaaaatacgagatatgacaatagaaaagtgaaaagacacagagaaacttggaggtttaacatggatttaaaaagtaagaaaatactcattgccggagctggaatcagtggaattggcgcggcagctcttttaggaaaagcaggaattccagcggcaatctatgatgggaatgaagcactagatcaggcagcagttgtagcgaaattgccggaaggaatggaagtatcttttgaattaggcgaatttaaagaagaattagcagataaatacgatatgctgatcttaagtccgggaatttccattcatcagcctgtagcacaggcattttatgtaaaaaataaacctgtatggggagagattgagttagcatcacattttgcaaaaggaaagatcgcagcgattacgggaacaaatggtaagacaacaacaacggctttagtaggaagtattttacgtgagtactatcaatctgtttttgttgtaggaaatatcggaattccatttacctctgtagcattagatacaacagaagattctgcgatcgcagcagagataagtagcttccagttagagactacaattgattttcagccggaagtcagtgcggtattaaatgtgacgccagatcatcttgatcgccatggaacaatggaagtgtatgcagatacgaagttttctatttctaagaaacaaaataaagatcaggtgatcgtattgaattatgatgatccgattacaagagctatggcagaaaaagcaacggcacatccggtaatgtttagtcgtttagaggaacttgctgaaggtattattttaagagatgatacatttatcattaaagaaaatggcaaagaaatgccggtatgtacaacttcggaaattaaattgcttggttctcataatcatgaaaatattctggcagctatcggcataacatattatatgggagttccagtagagaaaatccgagatgcagttatgaagtttactgcagtagaacatcgtatagaatatgtcgatacagtagatggagtagattattacaatgattccaaaggaacaaacccagatgctgcgattaaggggatttcttccatgacaaaaccaacgattttattaggcggcggttatgataagaagtctacgtacgatgaatggattgatgcattccatggtaaagtacgatatctcattgtaatgggggcaacagcgcaggctattgcggatactgcaaagaaacatggttttcataatgtgatttttgcagagacctttgaagaagctatggatattgcaagagaaaaggcaagaccgggagatgcagtattactgtctccggcatgtgcaagctggggcatgtttaaaaattatgaagtcagaggaaaagtatttaaggagatcgtccgaaagtttaaggggtgaatgctgtgcaaaaaaagtcatgggaaagtcaaaagatgcgggcgcaggccatagattattccatattgtttctggtgctctttcttgtagggtttggactggtcatcttatattcgaccagttcctacaaaggaagtctgctacataatgacacagcatactggttgaaaaaacaggcattttttgcagtgattggagttgcagggatgatgattatctccaggctggattatcatatctggaagaaaaaatggtggtttatatgggctgtttacggtgggacaattgctttactgcttcttacttttgtaattggagccgcaagtcatggctcgaagcgatggctgccacttggtccgatcagttttcagccatccgagcttgcaaagattacattgaacttgtttctagctgcatatataagcagcagggcgagacagatgcgcacagggaaaggacttttggaaccgtttcttcttgtacttccgatcgtaggcatcgtaggtattgaaaatttaagtacctgtatcatattgcttgcaatctcctttattatgatatttgttgcaacaccattatataagccatttcttggcttgatcggaattggtgtggccggagctgttttacttatccttacacagagatatcgaatgcaacgtattacagtgtggctggacccggcatcttccgataaaggggaacagaccatgcagggactttatgccatagggtctggcggcctttttggaaaaggacttgggcagagcatgcaaaagcttggttttcttccggaagcgaataacgatatgattttttcggtaatctgtgaagaactgggattatttggtgcgttgtgtgtcctggcattattctttgctttgctctggcgttttatggtaatagcgattaatgcaccggatctttatggctccatgcttgtgataggtgtgattgctcatataggtatccaggtttttattaatattgctgttgcgacaaatacaatgccaaatacaggaattcctcttccatttattagttatggtggaagttcactggtctttcttttattagagatgggcttggtactttctgtatccagatatataaaaataaaaaaataaaaagtaagaagacggggaaagaaaaagaaagatggaagagagaaatttaaaactggttgcagacaataatccaagaaaaagacatctcctcctgcttctggttgctcttgtagtaattatcggattgggaatatattttctgcttacagacttttctattcaaaaagtagaaataaaggggaatgatacatatacaaatacagaaatactggatgcaatgaaagaagatgggtatgtgaataacacccttcttatgattgcgcagaatcagatatttggacaaacctacctgccatttatcgacaagatatctatgagctatgatgacagccatatccttaaagtacgtgtaaaagagaagctgcgggcaggcgtttttcaatatatgaatcaatatgtttacttcaacgaaaatggaattgcgatggagagcaggaataccctttttaacggcgttccggttgttaccggtgtaaagtttaatgaaatgaagctgaaaaagaaaatactcgaaaataaagtcccggtaaaggaaagttactttaatacaatcgtatctattacgaaaaagattgcgacgtacaagctgacagtttctgaaatacattttgaaggagaagatgatattacgctgatttcctcaaagtacaagatatatttgggaagttcctcctatcttgatggtaaaatatcaaaaatcccatctatattaaagacaatttcgtcaagttataaacagggaacaattgatatgcagttgtatacagatgaaaagccgatcattactttcaagaatatgaagtaaataattcaaagtatctgtaaacattctcctgatttctcaaggcaattatggaaatttagatagaagtcagaaaaaaaagcaaaaattcaatttttctagttgattatttctataaaaaaccgtattatataactacatacattttaaaatcgggtgaattatatcagatgtgagatgcacagaagaagtatgtcatgcattgcatgatgcgcatctcgtagcaagaatgccggggcattcttgaaatttgcgaatttatatatttacatagaataaggaggagtaaaaccttgttggaaattatgtcaaacgaagaattagcacaagctaaaatcctagttatcggtgttggtggagccggtaacaatgcagttaaccgaatggttgacgaagctatcgagggtgtggaattaattggaattaatacggataaacaggctcttgatttatgtaaagctcctacaagagtacagattggtgagaagctgacgaagggactgggagctggtgcgaagccggaaatcggagcagcagcagtagatgagaaccgcgatgagattacggaacttgtaaaagaagcagatatggtattcgttacctgcggtatgggtggtggaaccggaaccggtgctgcacctgttgtggcgaagattgcaaaggacatgggaatccttacggtcggtgtcgtaacaaagccatttatttttgagggtaaacctcgtatgaataatgcactcagcggaatcgaacgtcttaaagagaatgtagatacattaattattattcctaatgataagctgttacagatttgtgataagagaacatctattaaagatgctttttgtaaagcagatgaagtactccagcaaggtgtacagggcattacagacttaatctttaagccaggtcttatcaacctggattttgcagatatccagacagtaatgcgtgataaaggaattgctcatatcggaattggtgttggaagtggtgaagataaggcagttgatgcgattaagagcgccatggaaagtcctcttcttgagaccacagtcagtggag

SEQ ID NO: 441 - DNA, 25755 bp, Eubacterium hallii
cgtattaaagatgtagacacatatgagaagtggtatggaatcaaacatcagagtccacagtttattgaagaagctgtttatgggctttgtgaagtgaacagagataagattaagaatgccagattgatcgcaaatccaggatgttatcctacctgttctttcctttctatttatccgttagctaaggcagggcttattgatatgaagtcagtaatcgtagatgcaaagtctggaacatctggagccggaagaggagctaaggttgcgaatctttactgtgaggttaatgagagtattaaggcgtatggtgtagcaacacatcgtcatacaccggagattgaggagcagttatcttatgcatctgggcaggaagcagttattaactttacgccacatcttgttccgatgaacagaggtattttagtaacagcttatgcaaatctggttaaggatgttacggaagaagagcttcgtaagatttatgaagatgcatataaagacgaacagtttgtacgtttcttaaatgcaggtgtatgtccggaaacccgctgggtagagggaagtaattatgtagatgtcaatgtgaagttagatgagagaacacatcgtgtcattatgatgggtgcgatggataatcttgtaaaaggtgcagccggacaggctgtgcagaatatgaatttattatttggtctgccggaaacagaaggacttttaatgcctcctgtattcccataaacaattattttgatttttacaaggtaaacatatataaggtaaatatattctgaagctggaggttattatgagagtgatagaaggtggcgttactgccgcaaagggatataaagcagcaggtcttcgtgccgggattaaggcaggaaagacaaataaagatatggcaatgatttattctgaaaaggaagcagtttgtgcaggaacatttacaaagaatgttgtgaaagcagctccggttttttgggatagagatgttgtatataaggaaggaaaggcgcaggccgttgtcgtaaacagtggaattgcgaatgcgtgtacaggagaagaagggcttgcgaattgtaagaaagaagcacagaaggcaggagaacttcttaacgtagcaccagagcatgtgctggtagcttctactggagtaattggagcgcagctggtgatggatgttgttgaaaaaggaattgagatgctggttccacagcttgcctatggaaaggaagctggagagaatgctgcaacagctattttaacaacagatacctgcaagaaagaaattgcagtagaatgtacgctcggcggaaagacagtaacacttggtggtatgtgtaagggtgctggtatgattcatccaaatatgggaaccatgctttcctttattacaagtgatgcggcaattgatcagaagcttttacagcagtttttaagtgagattgtagaggataccttcaatatgatttccgtagatggagatacttcaacgaatgatacctgccttgtactttgtaatggtatggcagagaatccggtgattacagaagagaatgaggatgctgaagaatttaaggcagcactcgcttacgttatggaatatcttgcaaaacagattgcgggagatggcgaaggttgtaaccgtctttttgaagtaacctgtaatggggctgcgacaaaggaggatgcaaagattatcagtaaggcggttgtatgttcgactttaacaaaggcagctgtatttggaaaggatgctaactggggaagaattctctgtgcgatgggatacagtggagtaacatttgatccagagaaagtagatattgttttagagagtgaagaaggaagccttgctattgtaaaagatggtattgcaacggattacagtgaagaaaaggcaacacagattctttcagcagatccggtgaaggcgattctcgatattcatgccggagaggaaaaagcaaccgcatggggatgcgaccttacttacgaatatgtaaaaattaatgcagactaccgttcataaagaggagatagagatatgacagaaatggaaattaacaacaatgtagatgagattatgacaaaagcgaatacgctgattgaagcgttaccttatatccgtcgttttaatggagcaacaattattgtaaagtatggtggaagtgccatgcttgatgatcagttaaaaatgaacgtaattaaagatgttgctttgcttaagttagttggtatgcgtccgatcattgttcatggtggtggaaaagaaatcagtaagtgggtaaaactcagtggaaaagaaccagaattttataatggtcttcgtgtgacagataaagataccatgaatgttgcggagatggttcttaataaagtaaataaagaacttgttggtctgatgcagaagatgggtgtcaatgcggtaggtctttgtggtaaagacggaaatatgattcgtgttaacaagaagatgccagatggaaaggatatcggatttgtaggtgaagtttctacagtaaatacagatcttttaaatacattaatggataatgattttattcctgtaattgcaccaattggtcttgatgatgaatttaatgcgtacaatatcaacgcagatgatgctgcatgtggtgtagcaaaagcgatggatgcagaaaagttagtatttcttacagatattgaaggggtctttattgatccaacgaataaaaagacattaatttctgagatggatattaaatctgcaaaagaatttattgagaatggtgtagttgggggaggaatgcttccaaaactcaataactgtattgatgcgattgaacagggcgtttcaagagtacatatcttagatggacgcgtggcacattgtcttcttttggagttctttacagaaaagggtattggtactgctattttaaaagagcctcttttttaatataggatgtactctcggagtctaaattaagcacaaaacgattccgagagtacattataggatagaaaacagaacttcaaacaattatataaatactttacagtggttaaattaagtgaggagtgaacagcatgacaaagatgcaggaatatatgcaaaagggagaagattatattttaaaaacatataatcgatatccggttgtatttgaaaaaggagacggtgtttgtctttatgatatggatggaaagagatatcttgattttgcagcaggtattgcagtatttgcattaggatataataataaagcatacaatgatgcattaaaggaacagattgataagattttacatacttctaatctttattataatcagccggcgatcgatgccgcagagaaaatcgttaagacttcaaaaatgtctaaagtattctttacaaacagtggtacagaagcgattgagggtgctttaaaagtggcaagaaagtatgcttatttaaaagatccttccaaagactatgaatttattgctatgaatcattcttttcatggaagaagtcagggagcattatctgtaacaggcaatgcacattatcaggatggttttgtaccggtagaaatgcgtgcagtatttgcagattttaacgatcttgatgatgtaaagtctaagattactgataagacatgcggtattatctgtgaggttgttcagggtgaaggcggaatttatccagcaaagaaagagtttttagaaggacttagaaaactttgcgatgagaaagatatcctgcttatatttgatgaagtacagtgtggtatgggaagatgcggttctttgtatgctcatgatctttatggagtgaaaccggatgttatggcacttgccaaagcacttggctgtggtgttccggtaggagcttttgtaacaaatgagaaagcttctcatgccttagtgccaggagatcatggaacaacttacggtggaaatccatttgcaacagcagcggtgtgtgaagtattccgtcagtttgaagaaagggatatcatatctcacgtgaatgaagtgggagcctatttatatgaaaagcttgaagaagtgaataatcagtttgcacagattaaagcacatcgtggtgttggtctgatgcagggacttgaatttgaaaaacctgttggggatattattgttactgctttgaaaaagggtctggttattatttcagcaggagccaatattattcgttttgttccgccgctggttattgagaagaaagatgtggatgaaatgattgccattcttacggaaacattgaaagagaatggaattcagtaaaaattaaatatcgtataaaaaagtaaaaaatctccatactaaaagaaaggtactcagggaatctttctgtgcttgattttgtgagtacataaaaataaaggaaaaagtatggaggttttttatgtttggaattattgcagcgctgctatccggagcgcttatgagtattcagggagtttttaacacagaagtaacgaagcagacagggacatggcttaccaattcttttgtgcagtgtacgggttttcttgtctgtcttattatatggttttttaaagaaagaaaaaagaatccgccaatagaaattttgacagtagaaccgaaatattatcttttaggaggggttataggggcatttattacatttactgtaattgtagggatgtcagcgttaggaccggcaaaagcagtgatgcttattgtggcggcacagcttattgtggcataccttattgaagtattcggaatctttggagtggaaaaaagtggatttgattggatgaaattattaggaacgggactgtttcttgcaggaatcattctatttaaagcaagagagtaaaagaaaattgtcataccctcttgtgttttttttagatattcggtattattaataagactatggacaatatgcaaaggcaacattttctgcggaatatgaagaaatattccggaactgtttcagtaaggaggagaattcctgatttgagacggagtatagtgagaaggttgattagcacagcacttggaatcgtaatgattattttgtcaggctgttctttttctgttcctgtaagagaggaagaaagtatagattctacagctattgtaagggcagaaagaaagacagaatggaatacagagcagacgaaagagacagagatttatgttcacgtctgtggatgtgtgaagaagccgggagtatattcgttacattttggtgcgagaacgcaggaggcgatcaatgccgccggaggtttttcggagaaagcgaatcagacagcatggaatttggcggaagttcttcaggatggaatgcagatttatgttccatcaaaagatgaggcgaaggaagcgcttaatgaagagcaatcttcacaaaaagatttgtcagcttcccaaagaaaagatacggtgaacattaatagggcatcgaaagaggatctggtaaccttgccggggattggagaatcaagagcagatgcgattattgctcgccgggaagaaaagggaacctttacttccatagaggaaattaaagatgtcgctggaataggagatggcatttttaatcgaataaaagatttaattacagttaactgaggtgtgttatgggaaaaaaagtgctggttgtcgatgatgagcgtctgattgtaaagggaattaaattttctcttgtacaggatgatatggaagttgactgcgcctatgatggggaagaagcccttgagatggctaagaagacagagtacgatattgttcttcttgatgtgatgcttccgaagatggatgggtttgaagtctgccagaggattcgggaattttctaatatgccaattatcatgctgacagcaaaaggtgatgacatggacaagattctcggtctggagtatggagcggatgattatattacaaaaccatttaatattcttgaagtaaaggccagaattaaggccatcatgcgcagaagctccaagagagtaacagaagatgagaagaagaaagtatttgagaagaatggattgaagatagattgcgacagcagaagagtatttgttgagggaagtgaagtgaaacttaccgccaaagaatatgatttgttagaacttctttctttccatcctaacaaagtttacagcagagagaatctgctcaatattgtatggggatatgattatccgggggatgttcgtacagtggacgtacatatccgaaggcttcgtgaaaagatcgaaaagaatccgggtgagccgctttatattcatacaaaatggggggtaggatactatttccaagattagtataaggagagttttccgctatatttcattatatcaggtagtcggaatcttaacatttttcctgattaatatttttttgatagtgggaatttcaagtcagatcaattattatgagaaaaaggcgattgatcagagagtacggtacacacaaaagcagtgtgccgtactttctaatcagattgtaaataatggattccgaaattataatatgagcagtctttcgggagagtccggggcgagtatatttgaagtggagcagcttgctaataatcttgaggggaggattctgttaatagacagccgctttaagattcttgctgacacatataatcgtaactgtggaaagtaccttgttacaaaagagacgattcatgctatgaacggtgaagaagtttcctaccgatatataggggatcaatatcttcagattattcttcccatagaggataagagcagtgaaaagccagatataagaggattgatcattgcagttgtttcgctgcataattgtaatgagatgtcggaatatctatatgatcagagagataatcttcttggtatttttataatcattacaataattttcagtgttctcgttgcacttctcattcgtaatagttttcgaagaatgcaaaatgaacttgatattattgcagcaggacatcaggaagaaggattggttgaagagaattttagagaattttataatctttcctctacttttaataagattattaatcgatataaggaactggagaatacaagacaggaatttgtatcgaacgtttctcatgaattaaagacaccgatcacttctatgaagattctggcagattccctgttgatgcagccagatgttccagtggagctttatgaagaatttatgaatgatattgttcatgagattgacagggagaatcagatcattacagatttgcttacattggtgaagatggataaaacgcaggcaaatttaaatatttcctctgtaaagattaatgatctgttagaggtgttgttaaagaggatttctcctattgcggaaaagagaggcattaagattcgtttggagacgatgcgtgaagtaatagcagaagtagatgaggtaaagctttctctggcatgcaataatcttattgagaatgctgtaaagtataatgatgataacggaagtgtagatgtttcactgaatgcggatcataagttcttttatattcgtgtaaaagatacgggatgtggtattccggaagattgtcaggaacagatttttgaacgtttttatcgggtagataaggcacgttcaagagaaacaggcggtaccggtcttggtcttgctataacaagaaatgttattttaatgcataaaggttccattcgtgttcacagcaaggaaggagagggttcaacatttatcatccgtatccctctcaattatattggataggagacagacacatgagaagattaaagagaaaaggatatctgttatttttcctgagtctgcttttattaagtactttgtgtggatgcggtggcaatacggcatcttccgcagcatcaaaggaaaagacggacagcggagaagggataacaacagaagcggcagaagataaggatacgatcaacttatattatctgaatgcagaagaagatgggtttaaaaaggttccgtatactttacagaatccgaatgattcggtaaaggcatcttatgaagtactttataaactttccgatacggaagggaataatacaagtgagtataaggcatccatttttgatgggattgcagtaaatgatgtttcgcctttggaaaacggaaaggagaacatagactttggtgcggcctatggtcagcttagtcatgtaaaggaagtattacttcgtacatctgttgtgaagtcgctgcttcagatcaaaggagttgaagggattactttttctgtcaatggttctagtttattagatacagacaaagttccggtagggctgatgaatgaagatactcttttaacagatgatggagagaagagtatttattcagaaaagaaaaaagtaaaactatattatacgaataagacaggagataagcttatttcctgttttagagaagtcaaagtaaaggataatgttccacttgaaacgcaggttcttcttatgctgaagaatcctccggcgtcaaagaagaacttgaaaagtccgctttcacaggattttcatgtgaatcagacacagattatgaataatacctgttatgtggatttgagcagtgatatagagaatgctgtagcagatgtaaaggaaaagattacggtgtatgcgatggtgaatactcttactgatctagatactgcttatcaggttcagtttacgattgatgggaaaagagtcagtaagttaaatgaatttgaaaagttcgatacacttctgacaagtaatttttctttatgtaaataatatgatgccagggtcaaaaggtcaaaacgccgttcgtgcttgtacgatattgatcccggatcaggtataagtataggtgatttgcgatgaaccgataaagggagaataagtgaaaagaccattttttctgttttttatggggcttgtgcttggagaggctgcagccatttctttaaacaggataggtttttttgtgatggctttgtttctttttattcttattttaatctgttttggattgtatcagagaataaaaagaaaacggagccctctttttatatatgcaattatattttatggtttattttttgccggaggtcttttgcttcttagagcagaatacccggatacggcagatcagatgcttgcgaaaagagagattgatggtacattaagcggaaatgtagagtttgtaaagaaaacagcggaaggggagtaccagcttacattaagtgaagtttcattttgggaagaagggaagggttctttaaagtataaaaaaggaagttatttttttgaaaattataaattaagggcgaaatgccgtattttaaagattaaagtatctgaaaagaagatttatccgggagatcagattagttgtacaggcagactgagtgcaatcaaagaaacttctaatccaggagaatttgatgcaagaacatattattattccttgggaatccgctatcagttctttggaaaggcgattagcagaaagaaggaacggcctttgtcagtatatcggatggcaggcagggtaagagaaagaatggatacagtttatcgctatatactttctgaaaatgaatatggtttactaaaagcaatgtttctgggagataagacagaactgtctagtgaagagaaacgtttatatgaagaaaatggagtggcgcatctgctggccgtttctgggcttcacgtttctatcgttggaggaatgttgtttcgttttttaagaaaaagaaagtttagctatgctgtttcatgtatctgttcaagctttgttctgttattctatgcgattatgaccggttttggaaattctgttttccgggcggtcattatgtttttaatttttttgctggcacagtatttcggagcggaatatgatatggttacttctatgagtctggcgggaatattaatgttatatgacagtccactgagaattctggaaagtggatgtattatttcatttacttctatttttgccattggaatgattgttccttttgcgaaagaactggaggaaaaacgaagaaaaagtaaattgataccgggtgaattcttaatagaaagcaagtggaagaaaagaataaggcaggcttttttaacaagtgttattatttctatggtaattggtccgttattgctgcggttttattatcagtggagtccatatagtgttttgctgaatctttttgtaattccggcaatgagcccgcttttgcttagtgcgattacaggtggagtcgtgggattgtttcagctatgggcaggcatggcaggatgtatccccgcagtcctattgttaagaggctttcatgtgatattccagtttattcataagatgccgggtgccgttattgtaacagggtgtccatcatggtggaagattctccttttttatctggcagagttgtgtctgtttatttgctggtattatcgtttatggagtgtgggatgtgtttttatacttatcttgattgcaggaagattctgcagaccggtgcctcctttacagatcagtatgcttgatgtaggtcagggagaatgtatttttttaaaaacccctgcaaacgaaaccatattgattgatgggggcagtacatcgaagaaacatatcgcagactatacgattcttcctgccttgaaatattatggaacagatcatctagattatgttataataacccatacggatgaggatcatatttcggggataagagaattgttagaagaagagtatcctgtgaaaaatattattcttccggatacgttagcgatgcgtttacctgaacaaaagacaggaaaaagggaagtacaggaaaaagacagagaaagcaagaaaaatatactggaagttataaaaaagagtaacgccaatgttttaaaaataagtaagggagatattctacagcttgacagaataagcctatcttgtcttcatccagtaaaaggatgggatgatgaagatgttaacagcggttctatagtatttgctctctcatatgaaaagtttacgatgctgtttacaggtgatctgccaggagaacaggaagcattgttcatgaaagaggtaccatcacctgtttctattttaaaaacagcgcatcatggctcaaagaattctacgacagatttattcttaaaaatggtgcatcctcaaaaagcaatattgtcagccggaaaaaataatttatatgggcatccacataaggaaaccataaaaagactgcaaaaaaatggagcagatatttatggaactttatggggaggtgcgattcatatcgagagtaacgggcaaaagtatcagataaattattttaaaaatcaatgaacacgaggaatttatttttatgaaagaaataaaaaaacagataaaagaaaaatctttttataaagtctatcttctgactggagatgaaccatatcttatccttcaggcaaagcatatgctgaagaatggaatgatcagagaaggtgatacgatgaactacgcagaatttaccgatgcgaaagtagataccaataccttgcaggaactgacatttacctatccgttctttagcgaaaaacgtcttttgcttttagatggaacaggaatcttaaaaacaggaaaagatgaatttgtgaatattatggataatatgccggaaacgacctgtattcttatatgtgaatcagaagtggataaacgttctaaagtatacaagtggataaaaaagaatggttatattggagaatttttaaaaaagaatcaaacagaaaaagttcttctgcgctggattgcagctttgcttggaaaggaaaagaagcagattcgagaaaatgatgcaatatatttcctacaaaaagttggagatgatatgtttcagataaagaatgaaacagataagttaatcgcctatgtcggagaaaaagaagaaattacaaaagaagatattgatgcgattacatccggggaagtacaggataaaatatttgaccttgtagatgccattgccagaggaaataagccggcggcacttgggtattataatgatcttattcttttaaaagaaccgccaatgcatattttatttctgatcgtgcgtcaatatcggattcttcatattatttccaatatgcgcacacttcgcaaaccagatgatgccatcgccaaaaccgctggaatcccacgatttgccattcgaaaaaatgaacaacagctaagaggttatggagaaaaaacattagaaagatgtatcgaggaatgtattcagatagaagaagacattaaaaccggaaaaataggagatcagattggagtagaagctctgatttgcaaattacttttaccctaatatcatacaatttggcaaaataacaagataaaataaaaaatctccgaaaagcagccgctcttttcggagataaatgttttattttaattaagcaattccgttaaccgcttttgtaagacgggaaacttttcttgctgctgtattcttgtggaaaattcctttagaagtagctttgctgatttcagaaatagcaactgttaaagcagcctgtgcagcttctttgtcaccttttgctacagcaacttctacgttcttaatacaagtttttactttagatttaatagatttgttccttaatgtctttgtttcgataactaaaattcttttttttgcagatttgatgttagccaatctgtacacctccaaatattattacttataattattattatgtttatattgttttgcattatttcggacacggacaatctaatgtaaacatacttctatattctattgattttcgagcagtttgtcaagcgtaaaatgaatttttttttgaaatatgttatactgagatgacgtttttaaatttaaaaggaaaggatcatttatgggtgcaatgtgtgagatatgtgagaatagaaaagacttggaattatatatccatattccattttgtataaagaagtgtaactactgtgattttctttcttttccttcaagcgcagaagacagggaagagtatgttcgatgtttggtaaaagagatagagcagacaggtatagttttaaataataaagatacttatcaggtaagaagtgtttttataggaggagggaccccatctcttctttccggcgatcagataaagaatattatgcaggtagttcagaaatattttcttataaaagaggaagcagagattacgatggaggcgaatccgggaactcttacaaagaaaaatctttctgcatataaagatgctggtataaaccgtctgagtatgggattgcaaagtgcagataattcctgcctgtatttattaggaagaattcatacatgggaagagtttttgaaaaattatgagctggctagaaaggctggatttgaaaatattaatattgatttgatgagtggtcttccgggtcagacgatgagtatttataagaaaacgcttgaaaaagtaatggcattgcgaccggaacatatttctgcatacagtcttattttagaagaaggaactcctttttacgaatcagaagagattcataaaaagattccgaatgaagaagcagaccgcgaaatgtatcagtttacaaaggagattcttgcagaaaacggatatgacagatatgaaatttctaattatgcattaaaaggaaaggaatgtattcataatcttggatattggagcggggttccatatattggctttgggcttggcgcatcttcttattttgaaggaactcgtttttcaaatgagagaaacttggaacattataaaaaagagccgtatgttccttttatgatgagggaagattatactgtattaagccaaaaagataaaatagaagaatttatgtttttagggctgcgcaaacgagctggcatttctaaaaaagagttcagggagtgttttcataaaaatatcatggacgtgtacggagaagtgatatctaaatatgaaaagattgatctgcttgaatggataaaaaatggggaaatgcttcgtcttacagatgcaggaatcgatgtgagcgattatattttctgtgattttatgttgtaaaaagattttaagaaaaaaatcgaaaatatacttgacaaggattgcagatagtgataacttaatgaatgtagatattagcactcgataatgatgagtgctaataactaagaaggaagggagtaagagatggaactggatgaacgtaagatgaaaattttaaaagcaattatttctacttacttagagaccggagatccggtaggaagcagaacgattgccaaagattctgatttacatttgagttcagcaacgattcgtaatgagatggcggatctcgaagaacttggatatatcctccagccacatacttctgccggaaggattccttcagatttaggatatcgttattatgtgaactgtctgatggaagagaatgatgagattcgaatcagggaaaccgagagggagaaggaacatcaggatctgattaataagatggatcgcatggaagaggttctgaagaacgttgcagatttacttgcagcgaacacgaactacgctacattgatttccacaccacagattaaggaatcgaagcttaagtttattcagctttctatggtggatacacagaggcttttggtagtaatcgtagttgggaatgatacggtaaagaacgtactcatgaatatggatgaaccacttggaaatgacgagattttaaaacttaatattttgttgaactcttttcttcaaggactgacactgaatgatattaatatcgagttagttcatacgatgaaggtgcaggcagggatgcatgcagatattttagaaggagttttcagtggaattgtagaggcaattcacgaagcagacaacatggagatttataccagcggagcaacgaatatgcttaagtatcctgagcttgtcaatcctgagcatacaacagcacttcttgatacattggtggagaagaagcagcttgtaaagcttgtggatgatacagtgaatcaggaagaaaaacatggcatacaggtttatatcggtaacgagacgcaggtacagtctttaagggactgcagtatcgtaactgccacttatgaattgaaggaaggcggaacaggaacggtcggaattatcggaccgaaacgaatggattaccgaaaggttgtaaatactctcagaaatctaaccgatgatttagatgagatttttaataataaatcatagaaaggtggtacttaagtggaagaagaaaaaaaagtatccgacgaaagtatcgtagaagaggcgaagggagagactccggaagaaacaacgacggaggacggaacggaagccaaagagacaaaagaaacaaagacgaaaaagaaaaagaagtctgcagccgctcttgaaattgaattaaaaaagagtgaagaaaaggcagcagagatgacagataaatatcagcgtctgatggcagaatttgagaatgccagaaagagaaatgcaaaagagcagagccatatgtatgatgtaggagcgaaagaggttcttgcaaagttacttccggttgttgataattttgaaagaggtttggatgctctttcagaagaagagaaggaaggggcatttgctcagggatttatcaagatttatcagcagatgattaccgtacttgaagaaatcggtgtaaaaccgatggatgctgtaggaaaggaatttaatccagattttcataatgcagtcatgcatgaagagaatgaagagatgggtgagaaccttgtatctgaagagttccagaaaggatatatgtacaaagatggagttcttcgtcacagcatggtaaaagtagttaattagtcatattttagatatatgaatttgacagaatacaggaggaaataattatgggtaaaataatcggtattgatttaggtacaacaaactcatgtgtagcagtaatggaaggtggaaaacctgttgttatcacaaatgcagaaggaatgagaacaactccttccgtagtagctttcacaaaaactggtgaaagagttgtcggtgagccggcaaagcgtcaggcagtaacaaatgctgacaagactatttcatcaatcaaacgtgaaatgggtacagattataaagtaacaattgatgataaaaagtattctccacaggagatttccgcaatgattttacagaagttaaaatctgatgcagagaattacttaggagaaaaggtaacagaagcagttatcactgttcctgcatatttcaacgatgctcagagacaggcaacaaaagatgcaggtaagattgcaggccttgatgtaaagcgtatcattaacgagcctacagcagcagctctttcttatggtcttgataacgagaatgagcagaagatcatggtatatgacttaggtggtggtacatttgatgtatctatcattgagatcggtgatggtgttatcgaagtattatctacagccggagataaccgtttaggtggagatgattttgataatgtaatcacacagtatatgttagaggatttcaagacaaaagaaggtgtagatttatctacagataagatggcaatgcagagattaaaagaagctgctgaaaaagcgaaaaaagagctttcttcttctacaacaacaaacatcaaccttcctttcattacagcaactgctgagggtccaaagcattttgagatgaacttaacaagagcgaaattcaatgaattaacagctcacttagtagaaagaacagcaacacctgtttctaaagcattaaacgatgcaggtcttaatgcttctgaattaagtaaggtattattagttggtggttctacaagaattccagctgtacaggataaagtaaaacagttaacaggtaaagagccattcaagggaatcaacccagatgaatgtgtagcaatcggtgcttctattcagggtggtaagttagcaggtgatacaggtgccggcgatatccttcttctggatgtaactccattatccttatctatcgagacaatgggtggtgttgctacaaagttaatcgagcgtaacacaacaatccctacaaagaagagccagattttctctacagcagaggataatcagacagcagtagacatccatgttgtacagggtgagagacagttcgcaagagataacaagactcttggacagttccgtttagacggtattccaccagcaagaagaggtgtacctcagattgaagtaacatttgatatcgatgcaaatggtattgtaaatgtatctgcaaaagatttaggaacaggaaaagaacagcatattacaattactgccggatctaatatgtctgatgaagatatcgataaggctgtaaaagaagctgcagaatacgaagcacaggataagaagagaaaagaaggtattgatgcaagaaacgatgcagacaatatggtattccagacagagaaagcattagaagaagcaggagataagattgatgcttctgagaaagctactgttgaagcagatattgcgaaattaaaagaagttcttgaccgcacaactccagataacatttcagaagcagatgtagcagctcttaacgaaggtaaagagcagttaatgaaagatgcacagtctttatttgctaagatgtatgagcaggctggcggagcagcaggccaggcaggtcctggaccacaggctgatgctgatgcaaatgcaacttataatgcagatgatgttgttgatgcagactataaagaagtataaacaaatagaaatgtgttttataacacttgtttaaaatgtaaatattcctctttcttactcctgcctgtttttacaggtgggagagaaaggggaaatttgtttatctcagtcgagaagactcccacctctttcaggtggtgagtgacagggctgctcgacttgaacaagaagttcccagtgtattgtatcattcataattattttgatttttcaaaacacctatggtatcttaactattcaggaacataaaactttatgaatgatagagtacaccaggttggaggataaaatggcagaaaaaagagattattatgaagtcttaggcgtagataagaatgcgtcagagacggaaattaagcgtgcatatcgaaaggttgcaaagaagtatcatccggatatgaatccgggagataaagaggcagaggaaaagtttaaagaagctgcagaagcttatgaagtacttagtgatccggaaaagaagagtaaatacgaccagttcggtcatgctgcatttgagcagggagccggtggagccggtggctttggcggttttgatttcggaggagacatgggagatatctttggagatattttcggagacttctttggcggaggcagacgaggcggcgatgccagaagaaacggaccaagacagggagcgaatcttcgtgccggtgttcgtatcacttttgatgatgccattcgcggcgtagataaagaactggagattacattaaaagaagaatgtaagacttgtaacggaagtggagcgaaaccaggcacaagtccggaaacctgtccgaaatgtaaaggaaccggtcaggttgtatttacacagcagtctatgtttggaacagttcgtaatgttcagacttgtccggattgtaacggaagcggacagattatccgtaacaagtgtagtgactgttccggtacaggatatattaaggttcgtaaaagaattaaagtaccgattccagcaggtattgacaatggtcagagtgtaagaattcgtgaaaagggagaaccaggtattaatggcggaccaagaggagatttacttgttaatgtaactgtgtcccgtcatcctaagttccagagacaggaatatgatatctactctacagagccaatcacatttgcacaggcagcacttggtggaacgattaagattgataccgtagatggtccttatgagtatactttaaaaccgggaacacagacagatacaacgattcgtctgaaaggaaaaggtgttcctacccttagaaaccgaaatattcgtggaacccatatcgttaaatttgttgtgcaggttcctgaaaaaatgaatgcagcacagaaagaggcacttcgtaacttccaggaagcaatgggagaagttgccccttccgaaaagaaagaagaagctccgcacgaaaagcacgaaaaacacgaaaaacataagaaaaaaggtttctttaagaagtaggaggaaagcttatgaagtggaataaactcactattgaaacaacaactgcagcagaggatatgttaagctatgggctttctgagatgggaatggaaggcgtcgaaatcgaagatcatgtgccattatctgaagaggacagaaagattatgtatgtagatcttcttccagatgagattgcaccggacgatggtaaggcacgtatttcctgctatgtagatgagaaagaagatttacaggctgttattgctaaaataaaagcgaaaatcgaagaattatctgcatttttaccaatgggaagcggggagatcaccttaggcgtaacggaagaagaggactggatcaataactggaaagtattctttaaaccatttcgtttagacgataatattgtgatcaagccaacctgggagaccctttctgataagaaagacgatgatattgtaatagagattgatcctggaactgcatttggaagcggatctcatgagacaacaaagctctgcatttctcagcttaaaaaatatattaaaaaagatacagaacttcttgatgttggaacgggaagcggtatcctttctattatcggattaaaattaggtgcgcatcacgcgatggcaacggatattgatccgaatgcaattcgagcaacgaatgagaactttgccattaatgaggtatctgaacaagcagaggtccagcaggtaaatattcttgataaagaggaagcagacagtttttatgagaaaaacaatggaaagaaatatgatgttattgtagcaaatattcttgcagatgttatcattccactttctggaattgtcgctccattattgaaggatgacggtgtttttatcacctccggaatcatcaatacaatggaagaggcagtaaaagaagcaatgcttgccaatcattttgaaatccttgagattaatcatatgaaagactgggtaagcatcacagccaaaaaagcttgatttatcaatttattaaaaatataagtaaaagtacactatctttacagatgcgatagtgtacttttttgtttcctcttattttggtaaaatagattttttgaatactttttttgtttttttacataatatttaaaagggtttggtcagaataatatagttggtgtaaaaaacgtatattacagattttaggaggtattcatgaatattttacattctttttcgcatacagatttggcattggaattgaaggatgagctggaggaatcttgtgaaagagagcagttttttgaaggaattactgtcagccacaaggagattggtgaaaaggggcttaaggaaacggtgattaagattgaaagcgaagccggagagaaacagcttgggaagccacaggggatttatataacgcttgagggagaaaacatggcaggaaatgatggaggatttcatgaggaaatgagcaatcatcttgcaaaacgtcttgcaaaattgcttttgggaagaaaaaaattattatttataggacttggaaatggggaagtgacaccggatgcactgggaccactcgtgataaaaaatctttttgtgacgagacatttgaaaggctggaaggaagtggaaggatgtccggtagtagcggcgctggcaccgggagtgatggcacagacaggaatggaaacgggagagatcgtggagggaatcgtgaaaaagattcatccggatgcgctaattgtaattgatgcgttagcggctaaaagttcagaacgtttaaaccggacaattcagatcagcaatacggggattgcaccgggatcaggggtaggaaatcaaagaaatgagattacggaaaaaacaatgggcgttccggtaatcgcacttggtgtccctactgtgatttctattccgtccctagcatgtgatattatggattctttttgtgcttcacagggcgaaaaaatggaagatacattttcttcctggtcggaaagtgaaaagtatcgatttttagggaagattttggatgctaaattatgggagctttttgtgacaccgaaagaaattgatgaggcagtgaagagaatcagctatacgctttcagaaggaatcaatcaatttgtttcaagtagaacttcataatcaaaaaggacaagcataagtttatattatgagaattattttgatttttgatacaagctgatgctgcgtttgcaaaaactgctagaagttgtatgttgattgggaggtactatgcgggagaagaatttaaaaacaatagaggggttattgtttgttctttttgttttattatgggggttatttttatccggtggaagcggaaaggtaaaaagaaggacactttctttatgggaaagtgttcccatacatacagaagtattccgagaattttttgaaaacggaatacaaaaggggaaatatgggctggcaccgattcttggatatgatacatacagaggggaaaaacggctgctgcttcctttttttcgaaatggaatgcagacagagctttttccgattcaacggtttgctcttgattactggaaagggaaaggatactataaggcaaaatatagtgataacgtaccaggttattttacagaatcagacgatcagtctgtagaagaaaaaaagaaagatccaggtaaaatgaagcagactggcacaggaagaacttatacgataaaagaactggcaagctattcttttttattagaacatttttatattgttgatgaaacgacatctatgacaaaacaagaactaaacgggataaaacttgtaaaaacagatttgtctgcaaagcttgggaaaggagaaccactggtacttatttatcatacacatgggagtgagacatataaaaaggtaaatggagaggaaggttctgtcattgaagtgggaacagcattacaaaaggaactggaaaccgtttatggaatcaaaacaatacatgacacatcagtgtatgatatggttgacggacagcttgatcgaaatgctgcctacaattttgcaggtgacagtgtggaagcagcactgaaaaagaatccttctgtaaaagtagtcattgatcttcacagagattcggtagaaagtagtattcatcttcggaccaaaattaatggaaagtccacagcgcagattatgttttttaatggggtcagccgtcttgcaaaaaaaggagatatcggatatctctataatccaaataaagaaggcaatctggcatttagtttacaaatgcagcttttatgtgggaaatattatccagatctgacaagaaaaatatatataaaaggctatcgctataatctccacctggtaaaacgggcgatgcttgtagaagtaggagcgcagaataatactgtaaaagaggcagaaaatgcaatgaaactattggcggagatgttatatcggcttttgtcaggagaaaaatcctataaaaaataaattgacaaatgataaggagtatgctttaataatatcagaaaatttaatttttcaagtcaaactgttgaagcggagataaaaatagttgtgcacgcacagagagtccggaaaggtgagagccgggtggaacgcagattattaaatggaccgcggagggcacagtcaaaggtatcttttacttagtacactgtgacgtgagggcatacgtcagttgccggggatatgatggtatccttcagagcgcacattttgtgaatcaaggtggcaccgcggatgtgaaagaataagtttttgagatgaaattattttgataatacacccgtccttgacaaagtagtaatacgttgtcatgggcggatttttttgttttattttagtcgggaaggcttccatccagaaatccgtatggcaacattgacagcagaagatggaggtaatgttatgattaaagaagcaattatcaaattaagtaaaaaagaagatttaagttatgaaatggcacagactgtcatggatgagattatgacgggagaagcagacgacattcaaaagagtgcttatcttacagctcttgccatgaagggagaaacgattgatgagattactgcttctgcagcaggaatgcgggcgcattgtacaagacttcttaatgatatggatgtattagaaatcgtaggaacaggaggagaccgctctaattcttttaatatttctacaactgccgcgcttgtcatttctgccggcggtgttccggttgcaaaacatggaaacagagcagcttcaagtaaaagtggagcggcggatgtgctagaggctcttggtgtaaatattaccgtttctccagcacagagcgcacagatgttaaaagatatagatatctgtttcctctttgcacaaaagtatcatacagcgatgcgttatgtggcaaatgttcgaaaagaacttggaatccgtacggtatttaatattttaggacctctttctaatcctgcaggcgcaaatatgcaggttatgggtgtttatgatgagaatctggtagaacctcttgcaagagtcctttttaatttaggcgtaaaaaatgctatggtggtctacggtcaggattgtctcgatgaaatttctatgagtgccaggacaacagtttgtgagattaaagatggaatattccgctcgtatgaaattgagccggagcagtttggatttaaaaaatgtagtaaggaagaacttgtcggtggaaccccagaagaaaatgcaaagattactttggcaattttaaatggggaaaaaggtcctaaaagggaagctgttttaatgaatgccggcgcaggtttttatgttgccggaaaggtttcgactttagaagatggagtgaaacttgccgccgaactgattgatagcgggaaggcaaaagaaagactggatgagtttgtaaaattgtccaatcagtaataaaaagcagtgaaataatacataaataaattgataatacgtccattgtgttgaaattgtatcaggattaggaataaaaaattgcaaaggcaggaaactcatgatagaataggacggataagataaaatgaatgtactcttggaatcttctcacaaaagtaagtgaagtgaagactccgggagcacatattataaaacaggaggaaactaccttggctggaattgaccagagtaaaataagaaatttttgtattatagcacatattgatcatggcaaatcaactttagcagatcgtattattgaaaaaaccggactgctgacagatcgagagatgcagaaccaggttcttgataacatggatttagaaagagaacgtggaatcacgatcaagtctcaggcagtacgtattgtataccatgcagaagacggagaagaatatatatttaatttaatcgatacaccgggtcatgtcgattttaattatgaggtgagtcgaagtcttgcagcttgtgaaggagcggttcttgtcgttgatgcggcgcagggaattgaagcacaaactcttgctaatgtttatctggcattagatcacgaccttgaaattatgccggttatcaataagattgatcttccgagcgcggatccggaacgtgtagtggaagagattgaagatgtaattggaattgaagcggaggatgctccgaagatttctgcgaaaaatggaatcaatatcgagcaggtactcgaacagattgtagagaagattccggcaccgggaggaagccctgagaatccattacaggcacttatttttgacagtgtatatgactcttataaaggagttatcatttttgcccgtattatggaaggaaccattaaaaaaggtacgaatatgctgatgatggcaactggtgcgaaagcagaagttgtggaggtaggtacttttggtgcaggtcagttcttcccatgtgatgagctttctgccggaatggttggttatgttaccgccagtcttaaaaatgtaaaggatactcgtgtgggtgatacagtcacagatgcagataatccatgtgaggagcctttgcctggttataaaaaagtaaaccctatggtattttgcgggatttatccggcagatggagcgaaatatccggatttaagagatgctttagaaaagttacagcttaatgatgcatcactccagtatgagccggaaacatcagtagcacttggatttggtttccgttgtggttttttaggtcttttacatttagagattattcaggaacgattagagagagaatataatcttgacttagtaacaactgcaccgagtgttatttacaaagtgcatcagacagatggaaccgtatttgatctgactaatccgacaaatcttccagacccatccacgattgaatacatggaagagccgattgtatctgcagaaattatggtaacgaaagaatatgtaggagcgatcatgacgctttgtcaggaacgccgaggcacatatatttccatggaatatatggaagaaaccagagcgcttttgaaatatgaactgccacttaatgaaattatttatgatttctttgatgcattaaaatcccgttccagaggatat

SEQ ID NO: 442 - DNA, 25604 bp, Eubacterium hallii
tagcagtgtccgtgcagcgatgtttgcacccggcacgggtatctgccggtctgtccatgtagggcagcaagggtacttcctcaatacgcagagaattgataacgatatgaacatggatattgccgctgtggttgtgtccgtccgggtgggtgcagacaatggcttggtgtccggggaaatgctcggcacaaaattcctcgcccaatgcttgcgcccggtctacggtcaagccgttgtccaccgcatcccgtgggtcaaagctgataatgtagtggtggttttttacatcttcccgcttctggttcttcccatagcggagattggagcgcatacaggcaacggcaaaatcctcgtcgccgcagttcagcgtggctattcgatagtcctccctgagcatgagccgcccgttttcatcaagggtgggcttcatggtaaactcgtcatgttcaaaggtgaggtactgctcggctgcaccgtagtccgcatttttagagctgatatgcttgaatgttgccaacagcgtcacctacctttcgcaagacttcaaacttcaaggcggcaaggtcggaaatggtggctcgcacttcaacggacagcgtattgtagggcgttccgtattcgttgagggcacgggcgatctgattaaggttgccgccgatttttccgtattcggctatcaactttccaacagcggacagcagttcatcattgaccggggaaacggtaacgatggggcgaatggtcgcccgtgtaatggcttgccggataaattcggattggctcatgtcatagtgtttcagccgctcggtaaagtcggcgtattcttcctcggtcatgcgggttttgaccacatggcagcggtggggtgtgttgtattttttcttcaagcgttgacctcctttctcgcccgacagggcgcatgagcagggtttggggaaggcactccccaacaagatttaccaaagggggcaaaaccgcagatatgcggattttggcaccgtggtagaatcttgctctaaaaaactaccgctttcctcgctctaaaaaactaccgctttcctcggcggctctggtttgcggatatactggcttgctccaccaatatagcgattgcggcggcgtgttctgcccgctgttcaccactacaacggtgaaaagggggcgttttggcaaacgcacggaaaattttttgttttccctgtctgctccctacaacaatccggcggtgtggtttgccaaagatttttgaaaatgggcgcaaaaaaagcagcaaacctttttcaagatttactgcttatatgccgctgtgatgggcggcggtattaaattgtcagccgtttttcaaatggaatttatctgcaatcgctttcttttcgctttccaatcccttttctgtaatcttccataatcctaacgcaatgatctgctatcttttgcattccgagttcttcaaaaaaagcaatttgtattttcatcagttcttcgcaaacagccaacttctgctcatccatattgctaatagcaagccatgggaacgctttatatttcttagtgtcaccaatgagaaaattgtaccctatcaactcattttcacggaaaacgaaatagaattgtggacctgaacccggaactgacttttccataatttgttgcatggttttcacaccgccgtatgcaggaaaaaaacctattcgctcaagagcatttaatatgtcaagccttttatctgtgggtatgtctctataattgataatctgttccatttgctccacccccattaaagtttaatttgtcaggctctaattatacaacttttctgcttagcggtcaaagcggaacttcaacaggctttctatcagccgcccgacgatatgttcctgcatatctgtgttgatctgtccgtccattttcgcacaagagcggatatatccggcataatgggataggacggcggcaacagcttccgggtcgccctcgcttgccttaacgattgtttcatagggaagtagctggttcataggacaagccctccaactctgcccgtagccgccgtaaaatcatctgaatacgccgcccggttgtgttgccagcccgtccatatctccgtccaatctccctatgcgtcaatcgttggaagtagtacaagaaaatgatttcctgttccatctgtgatagtgcggacagggctgcggcaagctctggactttccaaaagcaccatctgaccacagacgaaaagcggatagctggtcatgccggattgctccgcaaagtatttatctgtggtactgaatggatagtgtttttcttctatcagatattcaagcgagatttcccgcttgcggcggctccgtatgctccgggctgcgtctatggcagcgtggcgaataacagtcttgcaaaaggcatcgtgtgtatgccggatatgttcttgatacttttcgtgttcggtcatggaaaatccccctttctgaataatggcagagggcggcagcatcttgtgctgtcgccctcttgattaccgaacagcaaagacgggcggggctgtcaacggcggcgcatttgcgccgttcatcttgaccgttgacaggctcggctgggtttgctatctgctcacggcaattcactctcattgataggaattgcttcaaggtccgtattcaaattgttccaataagagccaatatccgcacttgtgaaatacttaaaaccgcctgcttctgacttcaattcgccgtttttaactccatagcaggcgtaaatcaaatcgtagcttgttccatctgagaggttaaatctaaagctggtcacatctgctccggcagtttcctcagttgttttgtcttttaaggataagtccttgaacttatcatacagggtctttatatcattttcagcaacaactactttcttttctgctgatgcaggcactccgtcatagtggtacatttcaacgctttcgacatcttcaacctcaaatgggaagtcgattttgacaggctcataagcaatgtttataggtaacagaaagagagctgtaaaaattgcaatggtacaaagagcgatggaaacgagaacagcaatcgttatctttttcctgcccctctgcttttcttttgcctcatggcgcataataacgctttcgctttcttcgtgaagaacatcttcgctcgtgtgagaaagcaatttctgataaattgcgttacaatcagcacaggcgttcaaatgctcttttaccatctctgcgcttgcttcgctgcaagcaccgtcaacatacagcggaagaatatctcgaacaatatcgcattgtttactcatgcttttcatccatcctttcttgaatttttagctttgcacgatgataagtaactctcgcccatgattctgtttttccaaaaattgcagcgatttgtgaaaaagatagttccccgaatacgcgaagctgaaagacttctttgtatggttcttccaaacggtgaagaacgaggtgtatgcggaacgccatgtcagaatctgcaactgagttctcaacattttcatttgatggcaagtcattgatttcactcacatcagctactcgctgacggcttcgcatttcatcatggtaaagattttttgctatggagcagagccatgtcaattcatctgacttacctttgaattgtgatgttgtagaaacagccttatagaatgtgttctgcgtgatttcctctgctatctcacgatttttggcaagagaaatagtatacgagtatacctgtaaatagtaggctttatagagcttttcatagtccatacttgtcatcacctccttcagcttcataggttagacggagaaatcggaatttcgttacaaagaagtttgaaatttttatacctttacgctactcttgctttctgcggactgttggtagacgcacattaacggcaagcaaagagattgctgtgtcagcttgatatgttcaaatgctaattaagtatagcatacagctatgaatttttctattgcgttcccctgacttcggaatagtggcagggctggctatccatgtcttgtgcttctctaccgtacatgagcatttgcacccgggttgtcgtttccataaccttccatcaggttgattacgccccagacaccaagaccggcaccgattgcaacgaccagtgtctgaaggatattgattgcactgctaaaaaaagccataatcaaatgtatgaacaaacgctttttcttatggtctgtaagcgtttggctctactcctttcccttttattcagacctttttatacccttatcagtagtagcagggtgctcgaattctttctttcatatcagtcctcactttcctcagcttcaatcgctgatacgtcttcttgtgttacagttacttcatacatttcaaattctgtatcttctgacatcaccagtcggtgtgccagatatttttcgacatcaaacgcattattcttattaaaatcggcaagctctttgtaccgtttatgctttgtgatgtcatatttgttgcttaaaaacggccggactcctcgaagctgtaagatacatttttctccgtccataaccgccagctcatctctactcatcagttcttttccagtcttttgatagttcagcccataggatcggttgctgcctctggtatctgatgtgttgtaaagatcaatggtttcctttcccagggtttctgatatttctttcagtgtggaactttcctttccgcccaagaaaagaacggtgtcacagttgcctgtgatcgtctcagcagcatccttatagatagttttcagctgagattgtgactgcaagatgatagaagctgagatttccctgcttcggatcgtagcaatcaatttgtcgaattttggaatctgtccgatattactgaactcatcaagaagtagccgtacatgataaggaagcctgccgccatgctcatcatccgccttatcacaaagcaggttaaaaagctgggtgtacatgatcgctaccacaaagttaaatgtgtcatctgtgtcgctgatgatgacaaacatggctgttctctgatcaccgatcatatccagttccatttcgtcatacgacatgatttctcgaagctcctgaatatcaaatggtgcaagtctggcaccacaggaaatcaaaatcgattttgcagttttgccggccgcaagcttgtacttgcgatattgccttactgcaaagtgttccggattttctgcttccagttcttcaaacaattcatccactgcatttttaaattcttcatcatcctccctggtctcactggcattgataaattccaacagagtagaaaagttctgttcttcctctggtgcctcataccagatgtatccgatcagtgcagaatacaaaagacgttcggccttgacccagaaatcttccgttgatttttcgccttcacccttggtatttgcgataatggtattgaccagcttcaagatgtctttttcactccggatataatggaacggattgtaatgcatggactttttaaagttgatcgtatttaataccttgatccggtatcctccatttaccaacatcttcccgcattcgacgatgatcgtacccttcggatcagtgaccacataggatacgtgatccgtcatctgcataaggttgggcttcacatagaatcttgtcttaccagatccggaaccaccgataacgatcacattcttatttctggcatacttcggagcttttggtcggctgttcatggtcagacgttccgtttctgtgaggatgacattgttttcaaagaccggatccatgaagggttcgatatcttttctatttccccatctggccgatccatactccacaccttgtcggaacttctttgcattttttgaacgatagtagaccaccagttttaatgcacctgcaaccagaacacctactgcaaggtcctgcaaagcgacacttggcagccagcttaaaaatgccagtcggaaattgactaacatcacgccaagtctctggaccatgctttctcccaggcaatgccggtacagccaggatcctttatctgctacatagaaaataaagaaatatgggagatttaagatcaccagccgtttgacctggatcttctgtaatttttcccggatcatcgttcctgacctctggatttttgtctctgcttcacacgctggcggtgctttgcttttctttctacagatttctgcagtttctttctgacggatggtttcttcgactgtttctttttcagttctactccggcatattcccggaaagccgctgtcatcacatccacatctttggccttaaagaagaccagaaatttcggtggatccgcaccaacctcttttttcaagctgtaatcaatgccgtattttcttgccacacgatcaaaagatttgatattttcatctgtgatctttaagttggaaagctgtactccctgtgcattcagctgcttgatggtctgctttccatgtggctttttcttttcaatcttttttcgggctttttcccttcctttctcctgagctcgtccggtcttttcagccattttcacctgcgttgctttctgtttcctacggttgtccatttccaggaacttccgaagggctgcttttagcacactggcagtgatcttgactccctggatgctcaggctgatcactttctgatttacttcttcctgcaattacccacgtcctttctttcctttcatctcagaataaagacgggcaatacaatatccgatgcatggaacatgttttccatacggacagccaccacatggtgttgtttttactgcttttttcttttccggaagcagatagtggcactgtttcaagctacagcctttcttttttcctccccaccagtaacagtacttgcaggaccatggcttttcttcgctgtactttcttccctcaatagctgcatttggttctatgatcagatctttattagtcttcattctgttcttcctcttttctcatgatttctgtcagttttttctctgcctgacttccggcagcaatgagacaatacaaaactgtaaatattgccgctgctcccagaagagcaacaaaaataatgatatttctcatggtttctcccatctaaaaaagcgtccacagattcctttcggtttccatgaacgctcattcttatttaattagtgtttcttttttctcataaatgcaagggctcctgtaccagtcgcaccaatgccgagaagcataaaccacagccacagattggtgttatccccagtctttggtgaatcactgacaggttttccaccttccggtgtcttttctgccggtttttcctcatctaccatggttacatgctgtacttcactggtatcctttacttcgaatcccacatcttttgcaaccagatagccatccggtgctgtttcttcacggagagtgtattttccgatcggaagcatttcgatgtaatgtgctttctctgtactggtccagctttccacaacttttccatcctgatcaaggattgtgagtttcgctcccggaagttcttttccggcgatatcctgtttggagattttcaccttcgttacatcatccttcatctcaactttctgcacatcggcagtatctttgatcgtgaacttcacgctttcagctgtcacgtaaccatcagcaggttttgtttcaaccagtgtgtattcttttccgacagtcagctcacggatcacatgtgcttctttaccggaagtccattcatccacgatatttccatcagcatctaccactttcagcttacatcctggaagttcttttccggttgtcagactggatttggtaaattcaacgacggttggctgattatcaaaggtaaaatcataagtgactgtcggctgatcctcacctgcatactcaaaggtaaattcctttacttcatcgttggttacgaatccgtccggtgcatagagctcttttacatagtaagttgctcctattggaagatctgcaacaaatgtgatctttccttcttcatccgtagatttcagttcaatgatctcatcggcttcgatcaggactttacctgttgtctcagacttaatgtcttctttggcaaataatccaaagatagcgccttccaatgtacggtcagaatctttttctttcttaagtacagtgacttctactctctggcggttgttctgccagtctttgtcatagactacaactggtgtattctgatccacgtaagtcagatctacatgacggatctcaccatccagtacatgaccgtaagcagttcctgtttctttcacatagtatttaccaagtggaagattttccagttttgcaataccggtttcatctgtcttgatcgttgcaatcagttcatcctttttatagtaatcgtcactgacgccatcggcagccttaatgtcttcctcagcatagacttcaaacgtaacatctgtcagttttccggttacatagttgaaaatgtgttccaccacacctttgaccttatcggccagtgtaacagaatccagaaattctccctttttgttgatgatgagttcaccaaccggtacctcgtccttcatttccactttctgaacctctccggtatctttgactgtgaatgtcacatcattggctaccagataaccatgcggtgcaaactcttcatgtagggtataagtctcacccactttcagatatttgatcacatgcggtgcatctttggaagatgtccagctatctactacatttccatctttatccgttactttcagataagctccatccagttctacaccggttgttgcatctgattttgtgatctcaacagttgtcggctggttcttctttacggattttaatgttactgtctgtacatcctgcccctgataagaagcatcaaatctcagtacttcatccgaagatacgaatccatctggtgctttcagttcttttacataatagcttccaagtggaagatccagtgtacatgctgcctgacctttttcatcagaagtcatttcctgtaaaagagtatctgctttgacgatcacttttccatctttcgtctgaatgtcttttgcattgtaaataccgaacactgctccggctactgtattgtctgtctcagcatcctgtttttcgacagtaatcgacactttctgtcgttcatctgtgacagagatttctttctcgatcactgcagtatcctgatccgcataagcaaattcgacattttccggtacagtatttaacacataagtgtccggtgcattcttctctttaacatagtacctgccaagtggaagattctttacggttgcataaccatctgcatccgttgcgacggttgctaccagtgcatcctttgcaaaatacagagttctctgtccatctgcatctacctgatgatcggcagtataaatatcctctgccgcatagacttcaaattcagcacctgcaagtccagccatttcatactggaagtccttatcaaatccctttaacacttcaccctgtttatagatctttaactgacctttgaccggggcattggtatattccacatcaatgactgcatctcctgtgacaggatcggtcagataagcagtatctgtatcaactgcaactgtcacatagtttttggatattgtgtacccatcgggtgccgtcacttcctcaatcctgtagttaccaggtttcagatttctcggcagtaccaggtatccttcctcatttgtgaaataggatttgtgtaccgttggcttcggataggatgttgtctgttccacatatttctgattatccaggtcgtataccttgaactcagtattagccaggagtacagatttctgtgtttctgcatcctttttgataatctttaattttgctttgaattctttatccagaagcactcgccatgtctgcggtgtatccggatgattctctgtgatcttcactataaaatcatcaaccggtgcatagttgtgtttgcttgtggtttctcttaccacataagttccatatggaagcggaatcgatcttgcatatcctttttcatcggtaaacatttctgcctggccatctgcagtcagtacaactggtctggctgagtcaaaatcataacttccatctgcttttactttcagatcactgacaagccatgctgaaaaaccaactccctgcagaagatctgcatcggtcttcccgttgtttgctgccttgatgatctgaaatggctgtttgatgaccgtttctttacatacagaagttctttctactgtcggaacagtagcaccttcgtaagtacagtccacctcatgttctgtcggatccagtacgtatcccaccggagcactaagctctttcagataatactttccaagatagagatccgatacagaagcttcgccattcttatccgttgtcagggatgtgatcaggctgtctttcttatggattgttccggttcttccatccggatgaacaatatcttcccttgcataaaggccatatactgcaccttccagcgttgcatcaccctgtgctgcattccctgtctcagcatcctgttttgcaatgttgatctttgcatttacacgtttgtctgttacatttttggtcgttgtctttccgatagcaagagtcacattataagactttgtatcgatctgataccctgttggaacagagatttctttcagataaacaacttcctgtgttttctccattgtgagctgtgaagcaccattctgatcagttgcaggcatctctgcaatcagctttgtacatgcagcatcggaatagatcccgtacactgcaccagccagtgcatttcctgtatcctgatctttctttacaatggatactttgcattcttttgtccaggttactttaaaatccacatatttctcatttccgacaccttcaccgaaaacaagagccaggtcctgtgtcccagatcctgttgtgatcttataggctgaatattccttatcaatacttcctttcatcttagaagagaaagtagcactgacattttctgactgattaagtggtgctatcagatagaactttgtaccaccggaaatctccacattagcccctgcagcacttgtttttccggttgtcacatttacaagctttacaccgcttggcaacttaaatgtgattgtctgcagtttatctgctttgaatgtgattacgcttgttcgctggctgtttccttccacataagcctttacattagattcagaaaagctcatatctacagacggaatgtccggcatatttacacaataattgtaaagttccattgccaggttctttcctgttgcattagttccggatgcccagtcactggatccatttgcataagctgctgcaagatgggtaatgatgaatctctttcctgccggaaaatccggatgtttctcatcgaagaaaccattctcatcacttgcttttgttccgtaatagcagacctttgcaagtgtctttccatcggcaagtttctggatcgtataagttccatttcccggtccttttttcgatggttcaacacagtatgctgtcgcattgatgcttccccatttcacataatatggacaagtcagataagaacctaatccatagtctgcgtaatagtaccaggagccggctgtaactgtgactgattttgttcctgtttcaccggaagcaagcatcattggcatatcaaaagtaatactttcgcctgcttcaagatctgcaagagcaacttcctggtcaacagcttcctgcataacctctgagagtgtgatccctgtttccggatcaacggtctcctgatcctccgttgcttcgatctctgcatcaaattctttttctgtcagttctgttttgctctccgtgtcagcagcatcagtttcctctgtagacgagtcagcctcagaatcctctgtttctgtcttatcggaagaaccagcatcctgatcagaagaactttctgactgcgaatctttctgttgatccgcttcttttaccacgatctttcgattgatctggtaggttgggtgatccgttgtctgtggttctacataatagactgccttataggaattggcataatcggtagaaaaatcattcccgtccgtatcttttgcttcctgaaatgtaacttttactttgctgtcatcctgaatcgtaagaccggtataatcactctttacatcgaaattgtctccaaccttgatctcataatcctttgcagttaccacttcatcttcatccaactgatccttgatctcctcataatacggaatcttttttacagatccggcatcatcagaagcataggcaacagcgggagagagtaccgttgatagaaccgttactgcagtcagtaaaccggacatcaccctgcgtgctttctttttcacgttcattctcttaaatccttcctttctgatttttttgtgtatggttatctgttcgtgtctgcgtattatcttttatacgaagatgatcgcctcctttcctgaaatttgcgctatttgggacagtcagcacaagctgagataacagcacaaatatatggcggtacctgtttgtcacaaataccgccacatgatttctactgtcatcctcttttcagattcagacattttattttgatttaagatttaagcgttttcctgttttctttcccggatccgttcctatatcagtttccatctctgatacgttttcttctggcagacacgcagcttttcgctctatgcatgttcaaaccaaatatcactccgggcaggctattcatttttcaaggtacatgaaggtgttctatgcaaacccttcatataacgaaacgctcagagcctgttttacagtggtctaattcaatttttttgaaatttttttaaaattcttcgttttccgccttttttttcatcgtttttaatgccctgttcaggaggtcatttacactctgctgtttgattcccagataatctgcgacatcctgctgacgcatttcttcgaaataaaccagattgagtaccatcttttgcctctctgtcaattccttgatcagcgcatgcagaatttctctgtcgataacatcgtcaacaaaatcttttgaagatcctctcataatctccgcatcatctgtaacatcgctgttagaaaatacaccatgattggtgctgattttgctctggctgtatgccatacggtcttcagcctccatcagcagacggatataccagttttcattatcaaagaactctttattaaattccttgttatcgccagttacactcacatattcatagtcatcacaactatgaagcggaaatacggttgattgatttcccgctgtataaagcacatatccgtgatcataaacagagatcgttgtatctgcattgatcatttcttttactacaactttgtgttctttcaaggatttcacgcttgggattcttttctccatatcagcaactttcacgattttcttcagttcttttaatgtcaacataatgaccacctttctgcctttcggctccgggtggttctttccatcttttatgaaatttctgcacagacataaaggactgcagcacaagaggtcacgaactcacccgttttttttgaacgggagtccgcgactccttgataacgcataatctgcttacataattagtatgttagattactgctcattttgggatttgcactgaatgcactctgatttattctctgcttgctgtttgcgaaacatggaataatcgcccatagcatcgtaaggacaacgccttacaaattcctggtattcgatttcggtcatctttgcttcctcctttgtgtcatattatcaaaatctctatttacaattttttttgcaaaaaagaattcaacctctatataacgaaacgctgagagcctgttttacagtggggtacgacaaaaaaatttaaaattttttcgaaatacgtcaaaaaagcccgacaaaacaaatacttcaacaatctccaaaaccagaaaatacttctgatcttgcagtgtatccgtaaatgttttgccgggctcttagtgattccagtcaggttcagctccttgacaaactcttgctgtctggtgcgttcttgatggttcctgccaaatccaacgcttactacagacagctcattctattctgttatgatccctgattcatcatctttcgggaatacgtccgcatcctggactttaattgttcatctctgatgtggatcggacgaaccgacaccatatcatcctttacaaatatctccaatgtactgcgacattttttgcactccacttctgaatcgctttgtgcgctcttttcaataaatgctccgcatacagagcagtgtacatgccatttaatagcacctgatcccatataggcttcctcctttaagcaataagatatttctccatttattactcaacggaccaaagggaaatcaaatccgccttatgagcatcatgccatccattccgtaagtgccaaagctgcacgaacagcacgatttctattctgatcagatctgctttgtcgatctgtgcatccttttttatccttccaccagctaccacacactctttccggtataaaaaattccgctgtgattaattaacatgatatttcaatagtttcaaatacatcaccagtcagatcacagatgtcctggatctgaatctcggtatcatcaatccgtaagtggactgatggatcaaaaaattctacggttccagataatgtatggtactgaccaattaatggattcttccatgacttttgaaaataagttgcctgtatcttcattccatatgccaggatccttaatttcatatccaactcatttttcttttcctcagataaatctctttttggttcataaatgatttcctgttgccggattgtttcatccagtccacgaagtgccgcaaatggagcaaactgttttgccctgcgtcctacatccatgggatgtctcctggaaaccggtcttggtaaatataaatacggttgatatgcacttgccagcactttttgcacctcctctaagcacggtgaccacctatttgctcattgcgttctctataagtagaacactccagcaggttggatccccgcatgatcgcattctttccataacgctgctttacattcaatactgcttcctgtaaatgccgttccttatcggtctgtttgggatcatcaaacaggctgtactgcacataactttcaggagcaaccctgttcgcacacacctcgattcttcggattccggtatatctgtctgcaatcctgagatataaatctttcactgcatctatgatctttttggaactgttactttctctttcgagttttacggttcctttggatgcctcatgctcatacctgtggtcataggcgatccataaggtgagagagcttgttaccagtcctttttcaaacagatccaggaccagattatctgtcatttcccttacgatcacaagtgcttcgtcaaaagaataatttcgcatcagcacctgaccatttgaaaggctgtgttcctccgaatgatagttcttgatgtcactcatccggcatgtttcatatccccatgcatgatcgatcaacagctctgcatcaatcccaaacatcttatacagccagtcttcggatcttaaagaagccattgcaatatcgcccattgtatggattccataaccggctagttttttttcagtccgggatccaatcctccagaagtcacttaatggtttatgatcccatagctgctctctgtaagagaattcatccaggattccaatatggtcatccacatgctttgctacgatatccattgcgatcttagcaagatacagattggttcccacaccagcggttgcagtgatacctgtttcctccataacctcctgcataagctttaccgccatttcttttgcagtgagatgataaagctgcagatagtttgtcacatcaataaaacactcatcgacactgtacacatggatatcttcttttgagacgtaccgcagatagattccatagatctttgcggaataatccatatacagctgcatccttggcatggctgtgatgtacttcacacaatccggtatctcatggatccggcaccggttcttgatgccaagagacttcatagccggagtgattgccaggcagattgttgactttgatctggtcggatctgcaaccaccaggtttgttttaaatggattcagcccacgttctacgcattctacagaagcataaaaggacttcagatcaatacagataatagaagtctgatcctgactcacattgccacctcccatacgtctttcctctttttgtaacatgtatcccattttgactatcaatgattgtctatccttcctgttttcattgaattacaggaaattcatttcacatatccattgacaaaagaggaaatattgtgtatcttataggaaagatgtttccccttatctgtgattcacattataggagagatatctccctttgtcaagattaatttttattttttaggagacacatttcccgttttgccttgaagcggctaatgaaacttataagacaaggcttagaaagaggtatgtttatgacattcggtgaaaaagtaagatcattaagaaaagaaaaaaagatgagtcagcaggaactggccagcatggttggtgtttcatataggaccattcgatcctgggaagtagaaggacgttttccaaaacaaaatgttctgtatcagaaactggcagatgcattacagtgtgacgtttcttatctcatgagtgagaatgaagcttttatcacagaagcatccgaacagtttggtaaccgtggtgccagacaggctcagcagattctggaacaggctgcagctatgtttgccggtggatcactgacagacgaagataaaatagcttttatggatgagatccagagcctttatctggattccaaaagacgtgcaaagaaatttacaccgaaaaaatatctgaaaaaccaagaggaaaaataatagaaggcgggattattgtacacctaatctgttaccttatagttacaaggatatttctgccctttttattttttacttttgaggtgatttatttgagaaacacttacatatatacagaaacaaagaaattaatcaagaaatatggaacccgagatccatttgagatcatggatcagatgaacattgtggtcggtgaaacttccagatataagacactgaaaggatactgttttatgagctgtaagacaatctatgtcatgatcagcagtttcctttcagaagaagaaaagatgatcgttgccgcccatgaattagggcatatcatcctgcatcgttcccagctgaaaatggctccaatgcaagatgataccctctacaatatgacggataatacagaataccaggccaatctgtttgctgccgatcttctgattgatgatgaggagattgaagatatggttcagaacgaagacctggattatttcggactctgcagctctttgaatgcgactccggaactcatgagctttaaactatacagcctgacaaaacgaggccaggcttatcatatgccgatggagatacagagtaattttctggcgaaataatagcggataagattattctacaatagaaaaactatagatttatctcactgaaaggaggatcatttatgtcaagacatcatatagaaaaggtaacttgtccttcctgccatcatgagggagattttgagctctgggacagtattaatactgcactggatcctgaaatgaaagagaaggtacttaatcaatctattttcctttatacctgcccgagctgtggagagacctttcgtttaaactactccacactctatcaccagatggaagatcttgtcatgatttatctggttcctgaatcagaagtaaagaagacatatgaaatattttatgaaaaaaatgctttggctgattatcgtaccgaaaagtacttataccggattgtgacatcagcaaatcagctcgttgaaaagatccagatctttgatgcaggtaaagatgacagggtaatggaacttgttaaattacttgcgacagattctattctcaaaaatgatcccgatatagaatttgatgaactgcgctttgctgtcgacgacgacggaacaaatattcttgtaatcattaataagggtgagattactggtgcagttgacattgacaatatgtatgaatttgcttcttcacactgcaatgatttcaaggatctccgcgatgatgatgaaatagttatcaatagggagtggatccttaacaaacttgccgaagcagaaaacgaatagtatatttggtggctacacccccaagcccctgtagaataaataacgccagtactggatatcaaaaatcccgcaccggcgttatttattaaaatattttgttttttaatcttcaacactctctactgaaacttcttttttcttcctacttttaccagaaatcatcttgtgtcctgtataaatagccataatcatgcaaagcaaagaacttgctgcaaagtacttatggccttcttttgatcccttataacctgtataaaaagttccaagcattgtaatcagtgcaccgatagaccaatatttatgtgatttcattcagatacctcctgccgtttttcttaatcatataccttttaaaagatatatacaaactggtattttgaatcaatcgacaagcagctcggatcttccactataaattcataccttcagcaaataggatatggcaataaaaatatatccggagatttctcttcctactggatgcagtcatccttaaagatttcaccagtagaacaagttgaacttttgaaaaatttatatcgaaacaacttcaactttactcctgctaatattcatgccgtcaaaaattccatccatcttaccgcctctgaaaatggagaatttatggaaaaaccggaaccggacgagtgaacgggcaggatataaatggctggtttataggttttatagaaagccaaaataatacatactttttctccacaaatattcaaagcgaacaacgtgcaactggtagtaaagcatcagatggtgctttatctactcgtattgattcgtcacataaatataagcatcttccaacgttgcaggaattgacatacactccaattctggctgtatttcagaaatcactcttaactgcaatcccccctcaacatactgtttagatgtaatacgatacttctgttccacttctcttgcttttctctcatcaggtactttgcaaatccagattttcccctgtgcttcttctgtcaaattcttcatagaacccgcatacagaaatcgacctttatgcataattgcaagctgattgcaggtggcagctaagtcttctaccacatgagttgaaaacaaaaccgttctgttttcagaaaaatctactaacaaattgcggatgcgaatacgttcctccggatctaaaccggtagttggctcatccacaattaaaaattccggttcatttaaaagcgcctgcaccaatcctacccgtcgcttcataccgcctgataactgcttcattttcttcttacgatgttctataagactggtctttttcaaataataatctatccgctttctacattctgctttcggaacacctgccagatctcccatatactccaaacactcctgaaccgtcaaattaggatacagttcaatttcctgtggtaaataccctatctttctttggattttttcatagtttccttcgctatacaaaattccgtctaatgtaaccattccgtttgtaggtttaagcacagtggtcaaaactctcatcaaagttgtctttcccgctccattttctcccaatagtccaaatatcccatttggtatatctaaatctgcatggtcgattgctgtgacactattcttaaatcttaccgttaaatcctcaatatgaatactcataaatttaccctctctttcttacgatcttcggcaatgccagtaacaaaatcagtccgatacaaatacacaagcctttcccatacagccatgtaatatcggcagtattttctatatctctaaaagaataagaaaacagattccatgctccaaaaagtttatctccacctgtggaatttgttgctacccatatcaaaagactgcttccaattcccatccacatattgcgaaaaagcatagacaatgtattagccaatattccccaaaagaaaatagttactacaatcgccccaaaacaggtaataaactgaagtatttcactttctgttactggatgtgtaattggtttctgaaacgcaaaaaacaatccatatccaagaacagcgagcagcagcaaaaaagttccctgtatcatcagtctctgtataatagaatagattctcttttttatctgatacagtctctgaacttcggaacggttgcttgtaatttcctgcacataagtatctgcacaaaaaacagcagtcaatatcgcaaaaggcggctctatggatagtcctatttcatacgtgaaaacaactgcacgaatcacacttaaaattacaacaaaggatactgcataagcaattttataaaatggcagaacaatcttcatttccttcttcatttatattcgcctccgcttccaaatctgtatcgaaatcagtataattactaccgatacaataataagaaaactttgatttaagagcgccatcgggggcggtgtcgtatcaaaaagctgccccggaaatcgtaccatgattgccaaaggtttgccccaatatccgtaaactccctctgcattagttccgcccaaattggaatacaccatataaagaatcaaaagtggtacacccggaagtggatttttaaatatgagtgaaatcaatgtatatatactcacaatcatcagcatattaggcaatatataaagtaccgtagaagccacaaaatcccatagtcgcacttcaaatccactatcctttgtatagatgcggcacaatacccaaaacagtatattcaaaatagttagcacaagcaaacaaattgtaaatcctgcactcacttttcccattacatacttcccggcagtcacaggctttgtatgcaacaattcataagtatgcttttttgtatcttgtaaaaataaaaccgccaacataataattgcaaaaaacaccatatacagacccgcaaaatcagcaaattttcttgcgtaataaaaagaaaatgtcttatcttccaattttttatctagatatgcgttgatttcttctgccgttcccttataatacgtactgtcctcgtataaataccttgccccgtaccagtcatattcctgctccaaatacgcataggcctcttttaaattcatgctttccagcttttcaatgacattctgtgcttctgaatccgtcaatccaaacacatccgttaattttatttttaccttttcatgccatacctctctgtgcttttcaggcgtggctggaatatagccctcatacacttctccttcaaccgaagtgttggactgatcattgatgatttcctcccccgttgtaagataatgtgtggttaaatatggacttgtcgcattaaacacaccataaatcacaagcagaacacctacccaaaataacggtcgctttagataattcctaatctctcttttaaaaatagcaatcatacgtattcctcctttccttcgttatagacatcataaaatataaatcacaacaaaaagacaacagcataaaaaaatcggaccgctcatgcaatccgatgaaatactgctgttattacagctccactctgtttttcattttctatcagtaactgaccaccatgcttttcacaatacaatctgctgatatacatgcccattcctgaatgtttcaaactgtctttcacattttgctgataaaaaagctctgttgccttttgcttatctattgtaaatcccactccatcatcctttattctgatctgtaattcagaacaggtaagaaacacttccatttccacttttgtcttggcgtaacgaaaggcatttgacaaaaggttttctataacctctaaaatcacttccttatctcctgaaaatttttcttctgtttccgaacattctaattcatatagctttccaaattttttcctaaacacgttcatctctgcccgtacgtctatttctacctgtttactggtaatttcttctgctactaactcccttgtatctaaactgctcatctttcgcatagtttccacaaagatatccatacgttcaatctgttttttgctttcatttaccatttctaaggcttgctccatatttatctctttcttcggaagatattctgaaagcatttcctgatacccctccagcacagagagcggagaacgtatatcatgtgcaatggcagcccgcaaagccttttcttcctcaagcattttccataactgttgattattctctgccagctgtcctctcattcgttcaaactctttgcacaatccgcccatctcatcttcattttcataagtgatatggaaatctaaattatttcgaccaacttgtcgggaagccagttctaattcttcgatagggcatttcagtttatgcttataaaaaagaaataccgctataatactccctgcaacagatacgataagcactgtaaatgtctgaagaaaatcacatatttccgatacatgataatcaaattctttcatttcataagaatgtggtctcggaacatctggcaaataccttctaccatccccttcagccatttcaaaatattcttcttggtctacataattccaccaaatgttgttttgtactgtgcttgctattcgcataattagtgctgaaagataaaaactaattattaaactaattatcatatacaaaacaatggttttccttaacgaaagattttttattttgcccatttatatcccctcccccataccgttgcaatatattcgtgttccgaatacattttcattttcttgcggattctgcgaatcaactccgtaaccacccggctgtccccttctgcatcatatccgccaatcttctcatagattcgttctttatcaaataccatttcagggttcatagacaaaaattctatgatctcatactctaatttcgtaagctctaaagcattccctttaatatgtacacatttactggcatagtcaatcactaattctccataaaacctttgttcttttttcctatgtaaacgttcttcacgtttcaaatgggcaataattctagcatctaattctttcaaactgaatggttttaaaacataatcatcaccaccagacaacaatcccattactcgatcctgttcttctacttttgcagtcaaaaaaataatcggacaggaaaccatatctctgattcttctgcacacttcaattccgtccattcccggcatatttacgtccaataaaataatatcaggatttgcacttatcttttccattgcttctatgccattttctgcaatcattaccgtataattcttcaatgtaaagtattgattcagcatttttagcaattctctatcatcatcaaccattaaaattttatagttcataaatttcacctctggctctaatgttatcttttccttatagtatagcttataaaaaacaacaaataaacaacaattcctaaaacgcaacagcctttctaaactgccgccttttctccttcattttatttccattatttatccacaatctcccttgcacacgattatatattgttcattctcgctacccattccatctgattttctgcctttaactgttccgtgatcccctgtgcctgtttcatctgctctacaattctttcaaaccttaaatacttatagtcatctgtatccaaacaaacaagccgaagtcgcacaacaacttgaaaatcttatcaacggaacaacagtcccagatactattataaaaaaggaaaaagagctccttcgagctcttttgattcagttctgtaaactggaatttgagcaaaagcccaagggactaatgtcccctatgcttttctcttttcttttgctgtttcagttcaaacattcgcagttcgtccgcttcttttttctcacggctcctcactttacgctcctgtttattctgttcctgctgtaatttcaatgcctgctgcgattttgtgccgatgcctgtttcctgcatctgttttttcgcttcacgttgcatccttttgggatttctttttatatcttttacaacagtatcaacagccggactgaatttcaaactaaaatagtatttttgaatatattcctgcacttcgtaatcctttggttctgcaccaaatgttaccttcgccacagatagtttaccatcttcaatacgttcaaatacacctacccaaaatggttcttcaaaatataccgtcagttttccacttgctttgtccataagaatccctcctaaaatgaattgaacaaagaatggacaacccggaggggcaggttacttaccctatttgcataggacggctgggctacctaccagctctagtacatttttaatgtacattgcgtttttatctttgtatttataatcaagccatatggcacgattaacttattcggtcaattccgatttgcacttcaaatcgttttctttattctatcatagcatccattattccgccatcagtctttcgaaccaggtatccatgacaatgataaactggcctgctcctggcaattcttgtagcatttcgtcaagagttttctgtttcacatatttctgcacatacacccaacaggcaatgctactggcttctgatacaatgtcagctatggttttgcgcataagctcttcaaattcagtaatttcttcttttgggacaacatcatacagtgttggtgcctgatgacttaattttacgccattttcatttgcatctttaagcagattcttaactttttctcttgaatcctccggtacttttatgtactcccacataaatgctaccacatcggacggtgtgtcttttttaagtggtggtaactgaatataatcattgttttcgctcattttcatattctcctcacgatataataaaatcaataatgcgttctcttgtcatgtccagtacagtatctacgaacactcctgcaaaaaggatcagatacagaattacactcagcgaaaacagaaatgcaacctgtacccagtcacggtaacagtatgcagtcgctataatcaacaaagtgaatataaacccaaggatccctctgacaaccgcataagtctgtactgtcatctttactgccagtccgatcacaaaaaggatcagccataccggcagtaataatattttcccagcaagttttaaaataaacatgtgcacctcctatcttaccagtcctggcatatcatggttcacctctgcctgataatacccgttcatcgtagacg

SEQ ID NO: 443 - DNA, 24708 bp, Eubacterium hallii
actaaataaacaacaggctgaatagcaaagtatgccattcagcccattacattatatttttgtattctataaacctatgattttatcatcaatctgagaggtttacacagaataatttacactaccgcaaaatacactcctgttttctatatttcttctcctaaaatatttatcataaatttttaaaacacttttttgagccaaactatatctcctatatttttacttttatcatatattccctacccataacagcatccagcctcctttcctaagatttctagttacaatataaaaataacattgcaaaagcggagaattgttttttagtgggtaaaacaaagcagccaatgcaaatttatttttacgttggctgctttacttagtatacctattaatttatcaaaaatgctttctcccttcttcaatatcctgctttatatttttcaaatattgaatatttcttttcatccaccttatatcactttttattgcttctatatcgtgaatattctttaaatttactttttcttcaatttctattttttctaattctttcctcatctccattgcactctgataccgctgttctttttcaaaatgacacgctttttctatcacctcccatactctttcatatctatcttctggagcaaatattctctctcccattgcatcctgcaccactatttgatttctacacataagggggagttctccaccatttagtaattgatacattaccattcccaaactataaatatctactgtcttatcaattttcattccttttttaaacatttccggaggcatatatgcagattcaaattcttcatcatttaataagtatgagtcagcttcgcgtgctaaataaaatcctcctaatttaaatggcccatctttattaataaaaatgttacttgggtttatatcctgatgaagaattttttgggattcacatatttccaaagccttacataaatcaattcccatttttactacaaaattagaatctacgctcctgttctttgtatattcttctaaacttgtaagtaattccatcctcacaacaatgtttgttgtatcttccttctgaaattgaaatacatcatacattgttaatatatgttctcttccctgcaattttgtgaggataacagcctctttcatcccctcacttatttcttcattcttaaaagtgattagctttacagcatttttgcttatatatccaaactgttcgctttctacttcataaaccgcacttaaatcatcttcccctaattttctttttactttccatttgcctaataaagactcatatttttttattcgttccatctttttctcctataaatactataaaaactaaacacttcaccactatctactgtataaattcaaatttatttttctaaatttatccatagcactggacgtactcctatacagtcatccgcaacactatcccccaaacggtttattccaccttcaaacgttaccctggcattcttattttctcttatacctggtgaacgtagatgccattcagcttctcttttaataaatactatagaacaacaaaaatcgtcatcttctatgctttgctctgttttagcataaagtcccttcatttctgcatattcactaccttttgcttgcctactttcatctgtaggtaaaagttttttcacttcattaatgctcaaaagaaatattctatccattgtatcgtttcccgcacttgttctacactcgtgattatcctctgctttcaccaacatcttctctattttctttcgctctgtctcattaaatgcagttctataaaaccaataatttaaccacctgcgaatgctacttgtttcccatgttactttttcttcttttttattataaggttttacatccagtatatatttactgaggagtaagactttattttcttctttttttaagattttccattcgataggatgaactgtcccatcttcatcccaccgatagtttccaaacaaaactctatcacctatatcataatatttcattgaatttatccccaatttttccacttctttagttacttctttcaaagaagtaatatctttttctatttgcaacaattctttttttatttcatttatctctgaacgaatcctctcctctcttttgttaatattctttttctgtcgttttcgttcataatcttgcaaattcactctgcttgtctccttttcttatatgtaaaacttcatctcatttataactgaccattattataagcgatacattgatacatttataaaccgtctgtataacgatatttctgcttaagccattgaacctatatataaaattgtgtataataataaataaaagcgaggtgattactatgtttaccatttcccagattggcatttcagacttgttatgtattttatatgattacagtccatattccacaaaagcagcatttagtgattatatgaacataattcgtgaaaaaattacaggaacctctttttcttccagtagaagatcttttttagaatggatgaatggttctcgaattcctcaaccacaaaatctaaatttagatatgtgtagaaagattttcgaaaatctttctacacaacaaatatcggattatcgttcactatataatctattggacatattatcaaattacaatattgatacctctaaattcacctcggaacttcctgaatcagtttctattttagaaaactccgaagatgccgatattaaaactgaacaactattagataatcttattgaggaacttttaaccgcagctttctccaataaaaaatctttattacaggaagaaaacgaagtgcctcttaaatcaaaatcagatttaccattatccaaatctacatatctttttgaaaaagagcttgcagaatttataaattatgtatatgtaaattcaaattcaccaattaatttttttacagaagaacccaactttgaaattattgataaaaaacttcttaacattcaatcttttatagacagggataacagatatacctcagatattcttcaaattgtaaatgaaatgagagatatttatcatgacttagtagaattttgtttatgtatttatgaatgtggcgacgatttaaaagaacatgtaatgactatagatattctcttcaatcctcaccatttttattgccttaataaatatgctgaaagccacaacactaaacttgattttgaaaaatattttgaaagtaacaatggtgctatcactgtcatggtcgatactctaaaatcacctgaaggaactgaagaatttattaatatgattttcaataccccacagatattactcataaaaatgaaaacctcattggataaattactgaatacacttaatcagtatttagactattaccatattaagaataaatgatttctattttttgtcaggatatcttactattacatattttgttctactacaatatcctgacttttttatatctaatttgttttacataatcattttttatttgctttttcagtaaaactatatttcatctttaattttcggtttcataagaaagaaaatccatctctaacatataatcaatttcatcctttaaaaactcatcatcatatctccttcgaatactagctgtatttttcaccgaagtatgtatattatattgtttattacacttatattgtgacttccagtttcctgaatatggtctgtcaaaatcccaactcaattcaaattcttttccatctccaactcgtttaaaatggtattctctggtgcctaagtctttttttaacatatcattttgctgctttttccattttaaattagagcgatttttccctctccatgaatagccagtgtgcgattttctgccttgatattctctattagatctattagatttatattcattcggccaataaaatggatgtccataaagcatataataatgcattatatcctttaaaaaatctctgggatttaaaatacggtctaatccatctacataaacatattttctttgtgtatacttatattctttaatataaagttctctattaaattcttcttcacattgtaaatcattttcattaaaggcgagctgactattatccagaatccagtttccttcatatctcatatcacctttgtatgaaaatcggtatgcaagtttgcagagaaattgatatttatttccaattttatgagtttcacctgttaggatattttttacaaaaaatatatcattcgttggattacaaatcgcatacatatttcttcccctcctcatgttattgttctttatttgtactacacataatatatcttgtatttttatactagcatattgggaggattgtcttttttacactaaaacaatatattcaacgtatattgagcagcatcagatataaatttttttctataaacaaaaaatattactttaaataactttttgccatatatttagctgtttgtttttcaacttcttttttaaaaaagtcataaaaaaaattagtgtatatccttaattatacagaatattcaaggtaaatcaaaaaaataatggaggtacacataatggacaaaaaaagagcacaacagattactaaacaaattggctacatgcttgtagatagcttgaaagtcgcttttgaagaaacacataaagaaatggaggaagaataatggcaactactgatgtatacaatcacgacacacaatatgatcttcaaaaaactattactctggcagaggacttcatgaatcaggaagaaaacttaggacgttttcatttgaatatttccattatccccaaggataagaatagtgctgaatataaagaatttcataaaaggttttttaaaatacaaggagcttttgcacgatatgaaaataatctgaacagaatcaccatttttttagatgatgatacttcatgtcatatgtactttatgaataaaaccgtccatagtagcgaagcaaccgagaaaatccgtgttggagaaatattaacgatttatgctctagctattggagattatactcaggatgcagttattctttgtatgttgcgagagaatgaagatgaaatctttaaagatttatataagatagatataacggagcaggttttaaaaatacgaaactttttcagactcgattcaaaaaaacaaaaggcaattcttaaacgccaaaaattgaatgtttatgaagagaaccagggaattgcctaccgcttttcttctgcagatgacttatcgttactttatgctttaacaaaacgctcttttccagtagaaattcaacgttctattgaagaattatttgaggaagtagaagatagagataaacatgctttaaaaaaattaaaatatatcctaaatgtttccccaatctgttcacaaagaaagcctttacagccagaattgtttgaacaagcacttgaagaaacattgtatggtatggaaataccaaaaaaaatccttgctgattttcttatttctaatgaaagagcaggaatccgcggctttaacatattattagtaggccctcctggtattggaaaaactgcacttgccgaatgtatagcaagaaattgccagattcctatggaaattattccgatgaatgccatgtcaactactttggaattggaagggctcgacagtagctatgattccgcttctattggacgcttctggaaaagtttttataaatatggtacttccgaaattctctgtttcttggatgaattggacaaggtcgagcagatatcgagcgaaggtaacccgatgaactgtttttatcagttacttaccggaacatttgaagacaagtttcttgaatgtcctctacctacctcaaatacaatttttattgctaccgcaaatagcttgcaaaatatacctgactcgattttaaatagatttcaatgtattatccctatgtatgattatacagtagaagaaaaaattattattggaaaaaattacattcttcctaaacttttaaagaattttagtattccacaaaaaactcttcgtttttcagaagatgcaatccgacatattattttgaactactgtcatactactggagtcagagaacttaagcatcatatggaattacttatcagaaatcttgttgcagaagatatttatgaaaattttgtagtttgcatagattatatagatatgattttgcaacacttaaatttaaataaaaagatttatactaaggaatggtgtgaaggaaactttccatctgtcaaaggtctgcctggtattgcacgagcacttaccgtaaatagaaacgggggacgttgtcttgccgtcgagacagttttgatgccattagaaccgcttgatgattctttttatattactgggcatgtcaaagaatccgtcaggcagtctgtagaagttgcttacttcttcttgaaaaaaaagtatcctaaattgtttcataaacaggcagttcatattcattttagtgaagcagctattttaaaatctggttcttcaggtggtacagctattctaatgtctatgttaagtgctgcattaggacgccccttaacaaaagaagattatgatgtggcctttactggcgagattgatatcatgggaggtgtttttgaagttggtggtattcctgaaaaaatatttgctgctaaaatctgtggatgtaaaaaagtatttattccactacaaaactataataaactggatgaagaattaaaacgggacatttcttgtaaaattattcctgttaagcatgtacaggaaatcattgaagaaatttatcccgacttaaaggagtaagaaaatctaatcagaattctcaaaaattatatagaactacccagcagaaagaaatgcgtctgctgggcggttaagcgggagtcttcggtaattgaattgtctaggatttcacttttatgatggattaaacagaaatttctatcgttttttcatcaagctccccacaaaagaatttgtctcagataatgccatattaaaatcttcttgttgtgctgtgataaatttaattaaaatattttcagtagccatgagtattagacctccaatgtttatattattagaaaagataaaatgatattactgttttttgattttgtttgataaaaattataaaataattttacacataaaaaaattcatcgttctctatacagtagcaacacagccatccgccatcctctcgatagccgctaccacaatcaatatccatataataaggagtaatgaatgcttcacttcttttgcctccattcaggtggaaagttggaaaatgtccaaagataatgtaatggtcaagagcctctagggtagtatctggcagattaaggatatctgtcctagttagaaaatgggaggcgtcggcatggtaagcagtttcaatagaactgataacatcaataacagtattggtatctgttttttgaaaaataagatgtttttggtcaagtcctgaatgaacaagaatagattttccgaacgcaggagtatctattgttaagaaaaaaggaagacattccaaaaatctccttaacgtactttgtgtagatggcatgagcacatctacctgacgtctagttgtttcaccgccaaatgcatcccacatagttccagaaagattaccagacagataacgtaaagcatacatttcatgattgccttttaaaagaatcatgctgccagttttaagaaactgggatatgtaagataacagttcaagggaatatgcatcgcggtctagtatatcaccaatgataattagagtatcttttttaggttgaaaatgtattttattaagtattttctgaaatgcaggtaagtcgccgtgaatatctgaaattaaataatgcatgaaaccacttcctttctaaaattcgcggttattttatatagaaacagctgttttttataaaaatattttatcaaaattagcatcatatttcaattttgacttgtaaattaaaattaatttttatagtaatatggtatattataataaatgaagtgtttcaaaatatttgttaaagtgatagatttaagatagtatttttttaacagaatttaaagaaaaggcaataaaaaattattctccagtacatgagagagtatatgaaggagaaaagaaaatgaaaagaataatttatcaaagaggggatgctgtttatgaaagttcttgtaataccggatatacatttaaaaccagctatgtttaagcaggcagcagcattaatgcatcaaggaatagcacaaaaggctgtttgcttaatggatattccagatgattgggataagcagctggatgtggcactttatgagacaacttatgatgaagcaattaaattcgctaaaaaatatcctgatacagtatggtgttatggaaatcatgatttgagttatgtatggcacgaggcagaatcaggttacagtagatatgcatcttatagtgtgcaaaagaaattgatagagttaaagacggtgctatcggaagataatccaataaaatacgttcatagaattgaccatgtattattttctcatggtggtgtatcggatttttttgtgaaaagatatattccaagagcaaaatacagtgatatagatacggttatagattgtattaatagtatgggaaagatggaaatgtggaatgatttttcgccaatatggcttagaccccagtatggtgatgtgagactatataagtcagataagtttcttcaagttgttgggcatactccaatgtctgctattacaaagaagaagaatattatatcttgtgatgtattttcgacctactctgatggtcggcctgttggaacagaagaatttttattattagatactattacctggaaatattgtggtataaagatttgattttctcctatagtttgcaaaattaaatttaccaactttttcggtctgtaaattctctccatttcctgttataatataaatttgaaagagtacatgaaggaatgagagaggtgacccagtatgaagtgcagattttgtggtaccaacttgccagatgatgcaagattttgttcaggatgtggacgagaggtagagagagaagatgtatctgcaaaagagaagaataacaatgaaacggaagatgcatactatagagagattgatgataaagagtacgaagagataaagaaaaagaaaaaagaagaagagagacaaagagaagaggtggcaaaggaagaagcggaacgcaaacttcttgaggagaaatatgccagagaagaggcggaacgtaaacggcgtgaggaacagcgtataatggaagaatcgcgcaggcggtatgaagaggaacagcgcagatggaaagaatttgtgaaaaagcaggaggagagtgaagctaagaagttatatcgaggttatgatgctggctcaggaacggcggcatcggaatcgacgaaaaagagacaggaagctaaatcacaaaaaaagaagaagtcttcgatgtcgtttctgctttatttatttattgttttagccggaggttttgcgctttataaatgtggatttccggagatgctgatagacagtattcataaaagttcttctgtttctgattcaaagaagaatacttcgtcaaagggtggtaaagataagaaggatgtagataagaaaactacagataacaccacttcggataaggcaggagagaagaaggaagcagagcatatgcttgaggatacagagaattcgcatatgagtgtggagaactgcctcagtacggatgcatataacacagtgatttcagaagatggaagttttagctttggatatccgaagtatttgtttaatcacagtgaggtgaatgcatcggggagttcgtacagtcttacatataaagaaggcggcgaagagaaaaaagcagaacttgctgtttataccgaggagaatgaaggaaatgcattagagaatgcgaaacagctttatgatagattttcttctcaggtaaataagatttattttaagatgcagccgacaaggacggacagcgaaggaatggcgcgcaccctgatcggggcttccgtagattcttcagagacgacaggagtatatattattgcagcgaatgatggggagaagaattatattttgaagtttacatatccggatccggatatgaaggatgattataatgcgattgattatgttgtggattgtgtgtatcgttactgttcttttagcggaggaacgtaccgtccaaggacatatcagcagtttttgaaagacgatatggggaagaaaaaataataatgcgaaagtatattatcgttatgtgtttaatagtttttgtgataagtactgttttttgttttgaagagaaagcagaggcgcaggcgaaggagaagcctcttgtgcttgttcttgatccgggacatggaggcagtcagtccggggcggcaagggataatgaaaaggtggaggaaaaggatttaaatttaaagattgctgtatatttgaaacaggagcttgaatcgtatgagaatacagaggtttatcttacaaggacgggagatgaagagatagaacttccggagaggatacagtttgcggtagagaaaagagcggatgcgctgctcagtcttcataataatgcggctggtccatgtgcagcatatgatcatggttgtacagtgcttgtggcaaaagatggttacaaagatgctcttgcgcgaaaaggacaagagctttcctgtaatattttaaatgaacttacgaagcttggacttacaaatcagggaattttgacgcgggattccgaggcggatgaacgctatccgaaccaagtgcttgcagattattatgcaattatccgaggtggggtagagaatgatatgctgactgttcttgtagaacatgcctttattgacagtaacagtgattataaagcgtatctgagcagtgatgagaagttgaaaagtcttgcctgtgcagatgcaacggggattgccaggtattatcagttggttaagaaaagccaggaagatacagtgaatcatggaaaatgtctgctagaacctttgaaagagtataaggagaagcttgtacatgtagttgatgggaatgcaaagcataatgagattagctataagacatattatggcgaagaaagtaaacaactgccctatgatatggaaacatttgaccagataacaaaggatatcaatgaaaacgtgatttcaatgcatatttcctgtgattaagtaaacaaaagaaaaaattcgtaacgaaagtttgtttctttacggtataaatgtgttataatgaacgaaaaaataatgtcgattttcgcaaaagaggcagtattttcttcgtgaaaggattgagagaatgaaagataagtcaataaagtcaacaatgaagagctggattatgttgtctgataaggaattggatgatacacaggtttacatgaaagaacaggaaggcgagaatgtagagtccatgtcagaagacagggaagctattcattatgacaggaatgctgcaggagattccggtatatattctgataatgatggattgtattcagacagtaatgaagaggagacagagtcagacatagaatctaagcaaaacagaagaggccggagaagaagattaagtcgtgatgaagaagtagaacagctggtacaagaggtaggacaggaagttgtaggtgcagatgatgaagagggaacgctgttccataggagaaagagacgtcaagataagaaggcggtaccagattctgagaatacaccagaaacacaggagaagcatccggaagttaagaaagtagattttaaagaagtaacaacagaaaaaacaaaaaaagccggaagggagcaacaatcggataaaacagagaagtcaggcagtatggggaaagtatttgctgcaggaatcggaattgttcttgtgcttattattgccagtttaggttatcagaatcagtctcttcagaaacagaatcagaagctaaaaacgcagatttccgctttgaaaaaggagaaaaagcaggcagaacaggcttcggaggaacaggcattacagacgaagaacgaagatggtgttgtagtgaacacagataagatgttctcttctgtaaaagtaggagataaagagtataaattattaggaaaggtatccgattttacaaaggatggctggaagttagaggcacttcgaaatgaaaatgcgacacttgttccaggagggaagcttgaaaaagatgcttatcttacgaatacagatggaaagaagattggcgtgatcattcgaaatatgagtgataagaatcagaaggtaagcgattgtattataacgaagctttcttttagtaaggaaatgtttgatgggcagattacattgccgggtaatctgacttttagcagtacggaaaaggaattaaagaaggccggctttaaaaaagatgcggatggaatctactgctatacaagcaagaggataaaagaagacaccgttaaaataccaatggcggacggagaatccgtatcagaaatcacattggaaagagcggtggatgaaagtacagcgacagccacaacagcaagtagttccgctacaacagcagcatcggaagatgaaaagaataccggaacagtaaagaatgagacaacagaagaagggaatactgtagaagatttctctcaggaaacaacagatacagtaacagaagaataagagaggaacagagaatttaatcaacatgataaggtgttgattaagttctctttttttatttatttataactgtgtaaaacagtgatcgtataaataattatgcaaaaaatattgactaattatgcataaagtattattatacataggaaagaccacaaaatgtgcataaaaatgcaaaggagcatacgaagattttcatttttaaacgatttgtgggatagtattgatattattgaagtagaggagagaaagatgaagaaattagtattaacaatgctttctattgcaggtatgatgctttttacagcattaccggcaaaggcatgtacatcttattatgtaggtaaagattgtacaaaagacggaacaacgatgtatggacgaacagaggatatttcctcccgtaaggacaaagtttataaagtaattcaggccaaacatgttgggaagaatgcagtatataaagatgaatcaggtgcgacagaatttcaggcaccgattaaagtcgatacaacgtaccgttatacgatctgccgtgataatgagggagatgaagatggatattttggagaattcggtacaaacagtaaaggtgttacaatgtctgcaacgacgtcagcatctgctgcaaagagtatcagacagtacgatccatatgtaaagaatacaggtattacagaagagaatcttacagattatattctctgtcaggcatctacagcacgtgaaggtgtggagattttagctgatgtaatggatacaattggtgcaggcgaagggaatggactttttatagcagataagaatgaagtatggtatttcgagatgttattaggccataattactgtgcgattaaaatgccttctaataaagcagcagttattccaaactgtctggtcatcggagatgtggatttaagtgataaagagaatgttattgcttctccaaaccttgtaaaagttgcaaagaataatggattctatgttccagcacaggacggaaagggcgatattaatgtgaagttatcttacacaggtaagggatatagtgctgggaatgcagacagaattcgtggtggacagtatctgttaaacggacaggataacacagccatttatacagatgattatcaggatattttcattaatgttaagaatgttaccgtagaaaagttatatgaattagctggatatcgttatgaggacatgaactttggaagaaatatttcacgagtaattggcgtgaagtcttcagcggaatgtcatattttccagattgattcatctatgccagcagaacttgctacggtacagtgggtatgtatgggtaatgcagatatgtcaacatttgtaccattctatggagcattattaacagatgtatcaagagcatataagatggaagcacacaattataattcccgcgctgcttattggattttccgtaatgtaggtttcttgtgtgaagatggggataatagaactgcatatggaaaaggtgtaaaacagttctatactgcatatatgacaaagatggaagaacttcagaaaaatgtaaatgcacagatgcttaatatttacaagaacgacaaagcaaacttagaatattatgcaacaaagcttggtattgcgattggtgatgagacaatggattttgccaaggcactgtatgcagacatccagacatgtaaagcagatggaacaacatatgaagtacccagtttaagtgcagatgatattacttatgatttatctatggtagctgcaccggctaagaaggcagagaatacaactgtgacaaagccggatacacagataaagaaggtagctgcaccagctcgtgtaagagtaagagcgaaagctttaaaaggcaaaaaggcaaaagtaaatctgaaaaaagtggcacaggcaagtggttatgaaattatgtactctacaaatatgaactttacaaagaaagcgacaaagaaagtttctaccacaaagcttacaaagacaatcagaaagctgaaaaagaaaaagacttattatatcaaggcaagagcttacaaattagatggtaagacaaaagtttatggaaaatggagtcttataaagaaagtagttattaagaaataatttacgaagaaagtagaatataatagtatagatcagtatcctttcaaatttatcaaaaacagaaaaataactttctcttttacatttactgtaaaggagaaagttatttttcgtctattgaaaaaaaataaatcttatgttatgattccacaagtgtattgttagaaaaaatagtgggagaatagagatggaacaagaaaagcaaatagaaaagaacatacaaaagaaagatatttttgataagattatggcgcttccgggattgaatatttttgaaaacatctattataaatataaagaagtattgttatatttattttttggaggattaactacagtcatcagcattggttcttatagttattgtgatgtggcattacatatgaatcctcttgtagcgaatattatttcatggattctggcggtattatttgcttatgtaacgaataaaatatgggtatttaatgcagagagacatggagtaaaggaagtgtttttggaaatcatcaatttctttggcggacgtttgtttacattagttgtcgaggaagtgattcttttgatctttattaacaaactgcacttcaacagtattttagtaaaggttgcagcacagtttgtcgtagttgtactgaattatattatcagtaagcttattgtatttcgtgagaaggaataatctctgtaacaaagagatcattatgatttactttgaagtgaatatcgaaacctgcgtagttcatgccgtagattcgttctggatcatgctggtaggaaggtcgtgggtcaagggaaaggcagtctaagagagactgtcttttttctatggggataaggtgcagtaatccttcaggacagtggatgacaagacggtgctctaaagcttttgtggaaaagcttccggaagcttccggatgggaatcggtaaaagcaagatatggtttgatgtcgtagattggagtaccgtctaataaatctgcaccggaaatatagagcagtggtccttccggagaagtggggatacatttttctaagcgtacagaggatagtccaagagggtttgggcggaaaggcgcacgactggcaaatactccttttcttttatttccgccgagtcttggcgggcggacggttggtgtccacttgtcacgctgatttttggaaaacccccaaataagccatagatgggagaattcttcgattccgcggatgcagtcctgattgcgaaatggttctgtaaatacgattttagcctgcaggctgtttactaaaccgctttggcgtggaatgccaaatttttctgaaaaatcagagtgaatataggcaatcggctgcagtgataatgaagcggcaggggtgctgggggaatgttgaaaagaactatgtttaaaatgtgaatctgtaggtgaaaattgtttttgttccataaatgatttcctcaatgatttcttcaaatatttgtattgttgtaatttcgttcatatttttagtatagtgggttcgatttacaaatacaagtgcaaaaaagctaattgggacaagatagaaattgcgtaaagatagaatttgagttataataagtaataatatgccggaatgaatggataattttttagaacataaagcagcgaaaaatgtccggtaaatataggaggataaaaatgagagttttagacaacttagtgccagaaaaggtgttttattattttgaggagctttgcaatatcccacatggctcaacgaatacaaaagcaatcagtgattattgtgtgaattttgcaaaagaaagaggtttggcatatcatcaggatccggagaataatattattatcttaaagaatggttcaaaaggatatgaggattccaagccagtaattattcagggacatctggatatggtatgtgagaaggaagctgactgtacgattgattttgagaaggatggattatctttagcaatcgatggtgactatatttatgcagaaggaactacattaggtggagatgatggaattgcggtagcaatggcattggcaattcttgatgatgatactctggaacatccaccgatcgaagcagtatttactgtagatgaagagattggtatgcttggtgcggtagcaatggattgttcttctttgaagtctcgtcttatgttgaatctggattctgagaatgaaggacattttcttgttggatgtgccggaggaatgagagtggattgtgaattcccagcagagagaagacgttggaacggtaagctggtttctattcacgtaagtggcgtgacaggtggacattccggtgtagagattcagaaacagggagcgaatgcgaatgttgttcttggaagagttctttatgaattaaagaaaaaggctgattttacagttgtatctgtagatggtggattaaaagataatgcgattacaagaagtgcaagagcaatccttatgtttgcaccgggtcaggaagatcttttcatggatatccttaaggaacagcagggaatcattgaaaaagaataccataagacagatgcaggcatgtctattgaaggatttttagagctttctaaagaggatgcagaaagtgttgacggtgtgcttcctatgacggatgtctgtggtaatgcagtaatcacagcacttcgtacattcccttggggtgtgcagaagatgagtaaggatatggaagggcttgtacagacttctttaaatcctggtattttagaaacaaaagcagataccgtttctcttgtattttctgtacgaagcagcgtagcaagtgagaaagaagagctttatgatagattagtatgtttgacagaaagtcttggcggaaaggtaagccgttccggtgattatcctgcatgggaatatgtagaagattccaagctccgtattttaatgggagatacttatcgtgaaatgtataaaaaagagcctgtaatggaagtaatccatgctggtgttgagtgcggattattctccgagaagatgccgggtcttgattgtgtatcttatggaccagacatttttgacattcatacaccacaggaacgtctctccatttcaagtacaaagagaatttatgaatatacggtagaagtattaaagaggcttaaatagtggaaaacaaacataaggtgcagtgttacgctgcacctcttgaagggattaccgggtatatttatcgtaatgcacatcataagttttttcatggagtagataaatattttactccgtttgtgaccccaaaaccgaaaaaaggcttaaataccagagagaagaatgacattttgccggaacataatcaggatatcgtagttgtgccgcagattcttacgaataagtcagaagattttataaaagtggcacagatgatgggagagcttgggtataaggaagtgaaccttaatctgggatgtccatccggaacggttgtttctaagaaaaagggaagtggttttttgtcagatcttgatgggatgaaagctttttttgatgaagttttttcgggagtgaacctagctgtttctgtaaagacaagacttggcatggagaagccagaagaaataaaagacttgatctctctgtataatcagtttccgatttcggaagtgatcattcatgcaagggtaagagaagattactataagaatccggtaaactacgaggcttttgcagaaggtttttcacaaagtatacatccagtctgttataacggagatatattttgtgcgcaggatgtacaggaagtaacaaagcgatttcctaaactgtcggctgtgatggtcggccggggaatgatcgcgaatcctcagcttacagaaagttttgactgtgcaggagataaaagcttagaattttcaaaaaaagacatagattatgccagatggaaggcatttctggatgagttgtgctatggatatgaatatattatgtctggcggaagaaatgttttgtttaaattaaaagaagtatggtcttatatgattccacttttcccggaatgtgagaagtatggaaagaagataaagaaggcaaagacagttgcggaataccatacggtcgtgaatgctcttttccgagaagcaggcgtgcagtagattatggtatatccccggaggtgaataacatgtggaagaaaataacagctgtaacgatgatttgtatactgtgtgcttttttctcttttcgtattacagatgcagcagaagtatcaggaaccaaacaggatgttacggattataaacagatatccgctttgatatcagatacatgggatgatgattattttgaaaaaatggtaattactccgggaacagatacgatggaaaaagatggagaacaggagcaggtttcagatacatttgatgttagttcttcaaaagcaaagagtataacaaagtcagaagatgttttagataattatcttgataagcaggatggcgtatatgaagttaaagagaatatggacggagatttagaagtgaccgcaccatatcagacgaagcgtcttattgtggaaagtaatcaggtaaaggatacttgtggtgcatcagaagtttatgtcaatgaaatggaccatgaaacgattttacagtatgattcagaggaaaaaacggaagaagcctttcagcagttaagccggacttattcatcctgttatccggataaagtagtttctattgaagattctacgatgggacttcctctttctcaagggggagagaatggccagggaacctattcctggggaagcgattatatgggattgaatgaattgaagaagcaggctgcctcaaacgggtatacaagacgtgtcactgttgcggtagttgacacaggaattgatacttccaatgttttatttgcaggacgaaaagtttcttcacaaagttataatttctttgggaataattataatgtacaggatacttttggacatggtacccatgtaagtggaattatcgcagatgctacgccggcaaatgttgaactgctagtacttagagtatctaataatgaaggaaagtcttctttgctgacgataaagacagcattgcagtacgctgtcagcaaaaatgcagatgtcgtaaatctgagtatgggatttattgatgtgaatgccagcttatatgattatcttgattcgacaattgataaggcatataatagaggaattcctatttgctgcgctgccggtaatggagaaggtggaagtaaaggtgtggatgttcgttattgttatccggcctgctatagtaagacaatcgctgtttcagcaattgattattcaagcaagcagcttgcctattactccaatcgtggaagtgccattgactttacggctccgggaagtggtattgtcagcgcttactataaagggaactttgcgacaatgtcaggaacatctatggcagcacctcatattacagcggcgattgcttatttaaaaatgatgcagtctaatttatcggtagatggtatttatcgggaattaaaattatactgcagggatcttggttccaaaggaaaggacagttattatggatggggctgtccgatcatgacgaatctgtttcaaagaggaatctcccataagcggtatatcgttattttccgtacaacactgaaaagtgtatccaatgtaaagaagggaatcaaagttagctggaaaaaggcatacggtgcagattcctattatgtttatagaagaaagaataagggatcatggaaaaaggtagcggtcgtgtcttcttcaaaagatttttacattgataaaaaggttaagcagggtaagaagtattcttataaagtacgggcatataacgggggcgtgtttggaggattcagctcagtaaagaaagcatatttcttaaagccactgaaagaagtaaaggtacggcgcaacaccaaaagaaaagcaaaggttttctggaaaaaaagaacatacacaacaacgtatcaggttcagtatgcgacaaacgctcgttttaaaaaggcaaaaaaagtatcggtaagccgtaaaaatgggagccttattactaaacagttaaaaaagaaagtatattattttcgggtgcgctattcttataaaaaggctggggtgaaatcctggtctggctggtcagaaatccgaaagataagaatacgttaaggaaaccttagaagagagtaaaagagtaagaatgaatacagaaaaacaatcggaaaatacaaatacattttcagaacagacaaaacgattagaacagcagatcaactttatccgcgagatggataaagaaaagtttattggcaggcagacttatttatcagatggaaagaggaaagagaatgatgcggaacatgcatggcatctggcattaatgacgtttctcttatcagaatatgccaatgaaccgattgatgtgttaaaaacaatggtcatggtgctgtttcatgatgtggttgaaattgatgccggtgatacatatgcttatgatgaagacggaaagaagacccaggcccaaagagagcagaaggcagccaaaaggctgtatggtcttttgccggaagatcagggagcaaagttaaaagcaatctgggaagaattcgaggcaaagaatacaccggaatccagatttgcacatacgatggataacttgcagccggtcatactaaatgctacgacaaacgggaaagcctggaaggaacatggagtatatctcagccagtttatggggcgacaggaagatacaccaaagggttctgagatattatggcagtacgagtgggagaagcttgtagaaccatttttgaaaaacggtacgataaaagatgattctcttcgggaataataatgtaaggtaagtagctttcgtgttaataagaagaaggattgtaaataaaaaatctcagtatagtatttgtgatgagcatcaccacagagactatactgagatttttatttatatttttatattttaaaagcctgcctaaaatcttacttaaaatattataggaagaaaatcagcatatcgattaaaaataccggaatcagacaactgagtgaccagaacatatatccaaagaaggatggcatcttgataccgttttcttctgcaatagagcgtaccataaagtttggagcattaccgatataggtattggcacccataaatacggcaccacaggaaatcgccatcagaaccaccttcggaataaaactggtcaatgtttgtacaccggagctaaatccaagagaagctgcggtagtaaagaataccaggtaagttggcgtgttatcaaggaagcttgatagtgctccggttatccagaagaactgccatggctgtgtcaatccaagatcagcacctcgtgctttcagaataagaagtgccgggatcatggtgataaagataccgatgaaaagaatggcaacttcttcgatggcatcccaggtaaagtggttgctgtctcggatttccttctttgttgttttaaaagaaagataggcggaagcaagtatcattataatttcaataatggaagcataggataaagttactcccatgatcgtaagtccttcactgaaaacaggaaacgttgtaggaaggacaccgcttaaaataactgctgcaacaatgataagcataaaggcaatgttgtgagcaccatctaagtgaagtttgacacgctcgctttccggacgaatctctggtttaaaaccatcagcgatatccttcttgtatgcttttgtatcaatcaggaaaaacagagtaagcaggataagaacattcaagagcattacaggaagcagattaagactccagaagaatccaacaccgttcataaatcccattaaaagaggcggatcacctaccggtgtgagacagccgccgatattagaaataaggaaaatgaaaaataccataatctgcactttgcgctgccgccatttatttgctcttatgatcgggcggatcatgagcatacttgctccggttgttccaatccagctcgaaagcagggttccgatgaggagtaatacaacatttacttttgggttaccggtcagatcaccttgtaaactgatgttaccggcaacacagaacagaccaaacagaagaacaataaaggtaagataatcaccgagtgttacttctattaaatgttctaatgcaatatgtccaccgaagattacagcgaatggaatgagaaataaaagagaccagaaagcaacgacccagggtttatgcttttcccaccattcttcttttatcagaggaaatatggcaatactcaggagcattccagcaaaaggaatacaactccaaagaggaagtgtagttccaagtgcagtatcagagagcgctccgtcagcagcaaatacatggagtggactaaacagcagaaaagcagaaagtccggtcaatagttttttcatttgttcaacctcctgtatcttggcttggtacttattgtagcttcactaatacggtacaccttcgtatgaaacggtattgtgaaactgccataatcttattatgggcgcacttcaccaaaataataaaataactaaatcaatactaagacgaagcctttttaatgtcaaaggacaatcatttggatttgtctaaaatagcacaaaaagttatgaaaaatgttagaaatttatttaaaaataaattaggaaaaaacttttgtatctgtttaaaaatagagcaatgtttgctataatatgacatatcatggaaaagggaaggatataggacgtgaaagaagaaattaatataataaaccaggtgaataacgatacaacgccaatcgtaagcctttccattacgaatctggatattgaggtggaagagggacgagtttacaaagattcctttttcattgagagtgagaataagattccgatagaaggatatgtatgtacaaccagcgataagatggcagtagaagtagagcggcttgagggaatccgtcaggagattcctttttattttaaaggcaagctggcgacggcggatagcggttttgaaggagacatagttctcattaccaatgggggcgaatatacgattccttactctgtcaaggtcatacataaatatatagaaacttcaaagggaagaatatctacgatggaagaattcgtagatatttatagagagaatcgaaaagaggcgatggaattatttttcctgccgaattttgaaaaagtatttctggaacatcttccagagcaaaagagcttatatcacagtctcatgaagagcagatcaagaagtcttatcttagaagaatttcttacagcggcaggatataaagaactgacgtttcttgaagtatctggtgaaaagattgtaatggaagagagcgatacgcagactactttgtcaatagcacttacttcagcagggtatgtagaaggaagaatttacagtgaaaagggacaggttcagccatctgtgagccgtttttccagtgatgattttacagaaggaacgttttcatttacgatagagaagaaacagaatcttcggaatggaagcgatgttatacgaatcgatacagttcggcaggatataaagattccggttgaatggtggacagagtcttctgctttgataaaggataaagaacagaagcttttattaaagaagaagcgggcagaacttatgcataattatctgtattttagaacaggaagtattggatttgaagattttgcggaagattctggacaggttttaaaagaattgtatcgttctactgaagagaatgaatggaagct

SEQ ID NO: 444 - DNA, 22573 bp, Eubacterium hallii
ggtaacgaagatgaaatggcaagactttgtggattgcgctaacgaataatgcacatcttttagtagaaaaacgtcttatttctcagcattctttaaaatgattaacattttggaatgctgagtataatgcttcaaatgttaatgtttccatttgaagcagaatccgttgcttactgtgtgtgttcttcctttggtttggatacatcggattatagttttccttacattgcaggctggagcagtagccgggaaatgaaagaaatgaaagcatctatggatgtaatccgcaagacagccggtgaaatgatcgatcagcttacagaagagcttgaaatcattcttgaagaaaaacagaaaacagaattacatgaaaaatacgggattctggtagatgcactggaagcagctggataccgctatgattatcgggaaagcgaaccgggacatattgtactggcaccggatgggacacatgaaattgccggatacttgcagtttgaatcatggggagatatcaaagactggttggaagatacgattgcagaaggaacagatatttcggagagagttgatcgggctttgtacccatttaagtttgattataccttagaggaagaaatgttcagaggtaatggtgatcgctatgcgatttaccatgtggatgaagacacaccgggaaaacaacatttatttatgaatatggcaatggtcaaagaagatggtattacaatcgatgcagcaaattataaatgtgtctattctggcagattacatgaaaatgaaaagctggatgatttgtacgccatattcaacgataatccaccggcagattataaagcacattctatgtcggtcagtgatgttatcattacaaaccgtggtggggatatgcaggcatattacgtggatcgatttggatttgcagaacttccagactttgcagcacaaagagaaaaaatactcgatattgtcccggaaatagaaaatgtggattatgaaaatgatcttacatgtatcagcttttatgcggctgaatgtgctgaatttcctgtgatgggtgaagtacattatgacctgacattaccagaagccttggaagcttatgagaaaatcccaccagaacgtatgcatggactgaaatgtgttggctttgatctgaaagacggaagtgattatgaaggaatgcagagtctgatgatcgaaggaaaagtacagaaagaatttttgaattcgattcctggatttagagagaattcttatgtgcaaaatgcaatcagtcgtgtggaaaagtacttggaagaaagacatccaaatgtggaaaatcctctggaatccaataagaaagtggataacgaaaaaaatataagcaaagaaaaaaacgagaaggagctgaatatacagatgaaaccaataccgaaaaagaaaaggggggaaatgagcctatgagaaatgtaaacctggaagaaaacgaactgactattactgctatcttccagcagcacacaaaggaagaaacaatccaaacactgaaagaagctttggaggttttggaacaggaagaaagtgatcctgagaatgatgaaatgattgagatcatcaattctacagttggaaaattacagcagatcgaagacaaatactactattctctggatctgaattattatctgaataacttggaggacgatgcctatgaagcttaatcaatttgcagtctaccgagtagatcagcagacagcaggaaaagcactgtggcatctgccatatcaagaagcaagacagcagaatgtgtcgattactgtcgaaaattaccgagtaatctcgattcatgaaatgcaggaagaagaaaaagtcgctgacatctggaaacgaatgaaaaagcaatgcgaagtcagtgacgtacttgtactgaacagggatggagaaatcaactgctactatgtagatgagaactatccacagtatctggccggattcattcgtatcaatacatcgggcgcactgatcactatggagactgagaattatcaaattgacggaaaaaaagggaactggattgcaacagacaccatcatcatcgacgggaaacagttttatctgatggaacatcaagtataccgggatcaggctcaaggtgttatcctggatgcctatggaaaaatggttgtcgaagaatgtaagaaattcgacgaaaaaacaaaacaaaagatccataattacattcaacagcaggcaccgctaaattcagtcgaacagttaaaacaagatggtaaaatccgtctggaacattaccagaagttctaccagaacggcacttatgaacgaagcagagaatccggtaccgaagccaattatgatatggtggacggtctggtaaataatcagaagaagaatccagaaaagatctctaatgcccgcagcaacaaacagactcccagaaatcaacaggatggcaaacctaagaaacgaagatccgtgattaaacgactgcatcagaaacagattgctattgctcgtcggtccggaaagccgataccaaagtacctggatcaggaaatggaaagaaagcgggggtagaatatgcgaaggttaaagtgtgaaaaagaaacgattattctgaccaatgaagatgacggattctatgatgtgtataccttcaatcagagcttgcagaaacggttgagatcctttgctgagaagtatccggatgattgctggttgaaaggagcttcggaagatggcagtgaaacgtatatgatcagaaagggacggttatcattgaatttaagaccaccctattccaaggataggattcataaagcaaccgaacgaattattgaagaacagaaagaacaatcaaaggattcatagaatgcgatttaagagaaaaaagcctcatgaccatgaggaaaaatgaaagcaaaatacgttagttgataaagtgtataggctcaaaagggaaagtgcccttttgggcctttttaatttaaaatagttctaaagaacaagttaacaatctgtagattctgtatgttttaaagatcaatcgttatactagttttagaccgaattatcgttctaaaggaggtgtcacaatggatttaaaggcggttggtcagagaataaaagctgcaagggaagctaagaatcttacacaagaagaattggcagcactggtaagcttaagtccaactcatgtaagtgttatagagagaggactgaaagtaacaaaacttgatacctttattgcgattgcaaatgcattagatgtttcagcagatacactattgattgatgttgtgacacattcggttactggcgttacgaatgagttatctgaaatgatagagaaactacctaaagaaaagcaacagagaattatcaatgcggtgagggcattggtggaataaatacatgaataagaagatggaagggcttattgctcttcttttttatttggtttaacgtgaaaatatgatatagtagttctaaagacttatatataattctgaggaacttaataaaatgaagaaaaataatataacacttgtatttgttgctatcgttttttcgattattgttggaatgataattggaaaaagcttattaaagtataaagaaggtgagccagatgtagttggcagtttttctatgaatagagatgaaaatcttacagtagttgctaacagaaaaaatatttctgataaagaagcatttgcaagacagcttttaaaaatgtacaaagagaattcatttcattcaataaaattttctacagatcatggatatgcaaccagccttgatatgaccgtatattcttggaaagaagatatcgaaaatggaaaatccattatgcagatagaatttagaccgattgaatatggaaaagattatgatattgttcataatctagataaatatgtgctttttatcgatggaacagaaataaaatgaaatatatagatatgcagataaagcgcagaaaaagaggattgctcaacgcaggatattttcaattattaccccaaaaaatgataagagagaggcagcggaaaagccgttgcctcatttcagtattatgacacttaatctagttctgcccctaactcatacctccaatactccgctgcctcatactccctgggttctgagagtaccggtacggtaaagagttcaaccggaacaccgagttttgatgcgaagagtttcataagatcctctttcggtgttcggacatcgctttcatactgagaaatccggacatcggcacagctttctggaaatccaacagccatgccgagttctttctgggtgagatgatttttctgtcttaagtgttttaattttcttccaaatgtaatcatagtattattctcctgtatttccaaaagccccggttcctcgttcattaccaaggtccaggacaaaatctgcgatcacgactggtgtaatcaccagctgaccgacgcgtgtgtctttatgaatggtctgagaagatgtgcttacgttgctgataatggcatggatctcaccacggtaaccggagtcgatcggtggaagttcgcataccagtccttttgctgccatgctgcttcgtggaaagacatatccggcaaatccatcggggatgataagaccaaatccaagtggaattcttgcaacctcacctggttttaatacgcaatcataaggcatgaatacatcagcaccggcatcattttcatgtggccggaagggataatgatctgctttcagaccaaagtcaatcagtttaatctttatggctgctcacctcccttctgatgagcaatggataatctgcttttaagatatctgacggtatccaaagttttgaaataggattctggcaggacatctgtttttccatacagtttcctctctgacagaatggaccggtcagatccggtgcaaaaagaatcgggcttaatttgtacaatctctgccagatctgtagcatcacaatccttgtttcatccgtatttcttctgcaggttctctgaccgatcatatgcttccactggtaaggcgttgcactgatgatcagtacgtttcgaagtccctgaggtgtggcatatccggctgaatcatgatcaatgcctaaggcacagagttctgtatagtggtccagatctgactgacagctttttttgtaaatatcctggatttctttatctgctttcatgatcccatatggaatagcaaatgcagcgtgaccggaataattgctgtactgcagagatgcactcatgtactttacttcgttctgatgccttgtgatctgtgccaggaagcgtctgcttgcaccaacaacagccacggtaatgaccatgaatttctgtacggttggatgtggaagccccgcaatgttttctacggtcttctgactgtaggattgatggtaaaggtccatcagatctgccatgctctgaatcgtatgaccgtgttgtgtgagccttgcagcaaagaccatattttgttctgcttcccggattccatagcagtttaagatagctgtttcaatgtgatccataggcctgttcctcctttaccagagcttttaaaaggatcagataattgatgcagtctgtgattttttcatcccactgttccatgtcaaaatgtaacagagtggaataacacatatcgtaaagggatacgacatgtttcgacatcatgccggccagtgctgcttttggatcacagttctgtaaagcggcagcaatcttgaatgcactgaggcggtcaatattatcaccggtatattctttctttttatgtgccagaatatcggcacactttctcatctgaagttcaaatacaacattaaattcttcttgtgtcatgtgatagttcctcctttgttttgtaatagttatcgttcgagatctttggtttttgatttcactggttctggaatctgcatctgaagaatggcatcaacattctgatcggcagtgtccagatcttttaatttttctttcaagctgcttattgcttcttcttcggaagctatctgctgttgcagtttttctttttgtaaagtcagggtttttaggcttgtcatctttccatcctgataaaaggatctcagccaatctctggcttcttcatatttctgaatttctttcgcatgttctttccggtactttcctttgtactttgcatttgaaaattgggaataaacttccttgtttgcatagtactgtccggtgtagcggatctgatcattgagagtccttagattggaccgatgctgagcaaactgtgtctgcatttctttcaattcctgctttgatgcaagcagtgtgtttttcaaatctgactgcgtatcaaatccatgttcctgcacatagataatggtatttgccatttgctgcagattagaaagttttacccgatgagcataagccgggctctgcattgctttcacatttgtctggagatttacaaccaggcacaggtgagatctgacgtagagaatggccaatggatccttgcgtaagaaggtctgttccaggtgttcttttccatatcgtgttccaagtgcacgttcagaaatccgcttctgtcgatcaggatgaagatagctgtatctgccacgatgctcaatcacagagatctgaaatagttccagaagtttagattggaattcatcaaaattactggaagtgacagcacattcatcaatcgcttgtcgcaaatattctttctgcgtaaggaatacggtggatgttggtttgagaccatcttcgataattttccgattgatctcatctattgtttgctggccgtgtttctgtgccatatactctttctgagtgatttttctttcagccggagcaagaagatctatctggtgaagtccttcctgtaggcaacgatccatgacagttttcttaaaagtgttcatgaatttatccgtggaacgatgcttgtatccggcaacttcttcatgtggtttatccatataaggctgcctttccactgcagtcttcctcacactgttgatgacgatgtgagtatggatatttccggattcattgtggccatcggtgtgagtaactaccagtgcctgatatccaggaaacatctgctttgcaagttccaaactgattgcttgtgctctctcgccggtaagtccattttctgtaacatcggctggatcgtagctgataatgtagtggtgacttttgatatcttcacgtttcttatttttgtgaaaatgagcatttgtcagttcgcattccttgtcaaaagacatcggatcacagttcagtccatccatataaaactcttttcgcaggatgcttcgtccggattcatctacaatctttttcccggttttttcatcatgttcaaacagaagataattgatagcagccgagtaatttgcatttctgcttttaatgtgttttacgattgccattcataccacctgccagtttcagtacctcttttcttaataggaataagtccgtgatgcactgatgaatctcattttctatagcacgtgactgactgccaccactgttaaaatgcttggcaatctgattgagattcgatccaatctttccatattcactgaccagttttctgagatcgttcatgtctgcaacaactttaatctgatgattgatttgcttctcaagcagaagttttctcagatattcagatcgtgagattgaaaaacaagtagctccttgatccagcaaattgagttcgacatctgtcagtcgtactgcaacaaaatgtctgtgatttagttctttatctttgttttttgttctcatactcctccttccgttgctactattccgcccactgggagtccacgtatttcaatatcggctgtcccttccgatattagaaatagtgctgtgaacacctttaggtgaaaccaacagacaagtgaaacgtctgttatgaagagggtatggggagatccccatcaagataaaacccataggagaacaggatgccaagtggcaatactgttaaacacgggtggatcttgctctgtatgtgtacccctctatataacgaaacgctgagagcctgttttacagtgggggaaaagaaaaaatatcaaaaaaatgatgattaatggtgagcttgtgatagaatgaaaaaaagagaaaagcataagtgttggatatatgcttcgcattgattgctggggagctgaaaaagatttaaaaaccacatatggatcagaatgtgcgcttacttcattggctgtggatgagcctttagaatatgcaagattatatctcgatggcaatttacagatgtggatagattcagaagattcacttgaattatagaataagaataacgggtagaaaacttctgatgcccattttacaaggggttcgagttttttatgtctgctggcgctatttctctgctggagtactattttcgggataatggcgaaaggctttagcggtatagttagaagcaccgtttccatattttgtattggttatggtttttatataatcgctggaataatagtcaattgtagagcaaatgaaatagacacaggggattaaggaagagttgaaggcagataaacagatggaatgggtagcaaataaatactatacaagagtgtgaaaagggaattttgaataaggagatgatttggcaataaggtgcagtaatctggtggaaagcaagtctgaaaatggcttgctttttgctttacaatgtggttagttgatgtatataattatgataaagagataaaattgatttttatattttggttcgatattgtgatgcagtttttatcccaaaaagagtaaaaatcgaattatccgcataaacacagggattttaagcaatatgaaacaaaaaataaaagaattttaccactaatttactacgaatgaaagaaccttgatacgacagagaaaacagcataaataaaggcaaaattggcatttcatacagaatatgagatgtcttttttgttgctgtaatacagtataactattctttttctgcttgattattaatcattttttaggacatgaattgtcaagagcttgttgcgtagcaatgtttacactcttgataatttatggaataaaaaatattctgacagatactagaaaagtgatgactactcaattttctaatgatataatatgataaataataatagataaacttgaagtgattaaggaagtgtatgccatgaaaaaatttttgaaaataatgttaatcataattggagcgatttctttgatttttgtagctctgatagggattgggttatttgttgatgttgaatatgatgaccatattgaaaatggtcgttatacttatgttccggaagaagaaaataaagataatgaatacgtggaatttacgataaatgattatgataaaaataatgccaagcttgtatattatgacacgattgaagaagctattcaactttccactttgaatgctgaaaatgaggaactttcggttcctgctgattttcttaatcatgttgatgaaaccttgcatatatggcaaggcaaaaaatatgatacgattttctatcgggctggaaatgataacgatgatattcaaggcttagtaatggctcgttgtaaaaagcagatacagaatgggcatacacaatacgcatttataaatgctacaccggttacaacgaaacgagatagaattttgttagatgatattacagagcttattcactcttctttgaaattaagtgatttccaacaagacttaaaccccgattatccaagcaagcgttttgtttacggctatgcacatgataaagaaatctattcattggaagtagaaggacaaaaaccggacggtgtaattgaaatcaatgtatatgacagagtcatgtatctatggtattacaatgacttacaaagtaacaaaagaggtgactgtttaagctattcggtagatgtacctaaataaaatgacatttttacataatactatattattagttaggcagacggagtgatccagacacggtggcaggaaaatctttcagatttttctgccatgtcttgcaagtggctggtttacttcgtctgtgagcgagcctgtggcgagcgaagattaagcccccgttatctaacaaggggggcacaaaaaacaaaagacactatacactaacaggcggaaaacgctgtatttacaaggcaaaaccgcattttataagatgtgatataaaaagtatctatttcacaaaagaaaaacaataaatttaaacattataatattttaatttttgtggtaatgatatgcaaactttttaggagggaagatatggattgtaaaatgactgatattattgctattatttcaagtatcattgctattggttattcaatttattccataattactaaaagttatattcgtcaatacaaccttgaaaaatttgaacatttttctttaaatcagaagaaagtttgtattgttttcaattttattatgacacttataattgggataagtggggtgtatatattgctattatacttattctaatgggattgaaagcatttatgtagcaaatagcaaaattttataagtgaaacgaggtactctatggaaaaaaaggaacttatcaaactatatttacaaaatgtggataaaatgtttggatatgccaacatgaacgcatatattgatgagcgattaaagaagtatacgaaatactgtcaaagtaaaaagccagaagaacagattattatatggctgaaattattgcatgaaaatttcggaaaaaagattgtttatttaggaagttacttagcattacaagaaaaggatatgagctatttaaataatgcgttcaattcggcagtaacatggggacaactcacaataacaaacagcggttgcgaccattccattcacgcttggaatattttaccacatatattctgtgcaaaccgctttcgtgacattgaaaaaatatttccaaaagaaaacggacttagtaagaatgcagatttatgagtggttataagaagtatctgccaaaaagaaaacaccgataaagcctgtaaaatagggatatatcggtgttataagaacttatgaaaagataattagaaatttattttatgttttaatggacaaaacaattgtcaaggatggatggctatatagaaatggatttttaaggaagaactgtaaaataagattaacggatattacccagatgaaaagaaaaaagaatttatttggagaagctcttattttatataaaaatcagaaaaaaatcgctaaaatttctgcccgaaatagaaatgtggactggctgcaagtaaagattgcagaaataaaaaaggataagaagaaattagaacgtaaaaaatgaaaaatgtgaatcatatagggagattgagtttatggataatgtcattagattaagtaaatttgtaaaaaatttaggaatagtaacaacagttctttttttaataatcgtactggtaacatttgttacaggaaatatgggggttgcgatatgttttatgccttttgtatttttaggtattgctttaattttggcatacaagaaacaaataattgtagtaaatgaagatgaaattgtatttagctatctggttaagaaaactcagcatataaaatataatgatattcgttgtattttaatgattccattaaatggtagaacagatgtcatattaattgataagatgtacaatagacttgttactctggagcaagtgtatgtaaattatgatattttatatgatacacttataaaacatgaaatagatcttgtggattttggtgagttagttgaacagaacaaagatgtatcaaagtatgtacctgctttaaactggatagaaaagaatttctataaatctatatgtaatgagaatacaactatcaaaaatatgtcaaaaacaatagaaaaagaaaagcgtaaaaaaacaaagcaatttttaaaagctttaggttggattctaataattgctgatgcggtagcattttttattggtggcaaaacaatgttagttatatttataatggttttgatgattacatatgcagtgtatataaaatattatccatatatatttatagaagtcaccacaaaaaaaggacaagaactggcgtatcaattaccatttatgggtgcagcaatagcaatgcttttatccctgaatacgagtaaactctttaattatgaatttggaaactatatgaagattacggcaattattactgctttacttgcactgccatttattattaaatctttaaaaacagatgtaccacagaaatttggacgtaaactttcagttgtatttgctgcttttataatcgcatttacaattagcttcccaataaattttttatttacatttgatggggcaactcatgaaattgcaattgtaacagacaaaaagattagcagtggtaaaactagagatagagagttatatgtaagttgtaatggtaaaagagaaatatatactgtttcaaacagtgaatatgaaaatacatcaataggcgatagtaaaagaatttgtagaagaaaaagtgcattaggattggaatatagtacgatacatgattaatatttatttaaagataaggaaggaatatataagatgaaaatattgttagcagtagttggaggattattattactgatattcccttttatagttatgaaaaaagcaaaagtaacaaaagaagaaaatactgatgaagcaaggaaaaaatttaatgtgtttctcatttgtatgatacctgttcctctaataggcttcatatttcttttaatagggcttagaagttttttataaaattaaataaaggagaaaaatgttaaaaaacaatgatatatcaataccagaagcctgctatgcagatttatgtaaggtgggtttttttgaaagaaaacaggttaaattaacaattatatggaatgaaaaaataagcagaaataaacaaatacttacacttaagaagttatatcctgaattaaataaagtgtctacagttgaaagctataaaattacaaaaaaacgaagaaatggcaatttgcagagatgggatggggatttgctgttgacttttcgcataaagcagaaaaagcggggataaaaatattgttagaagaataactaaaaatcttgctaatgtataagttaagtaaaaaatagaatgaaaaataatcatatagcagaggagattgggtaatatgaaggaacaaaagaaatcttcttggggagcggttctggtgtcatttttaaaggaatttctattaaactcattcgaagccccaggtcatctttattatgatgaaaatttaactaatgaaggaaaaagaaagaaaaattatatttggagggtgcttctactggtgactgcggtaggagtagctttgcttcctgttatagcttggaacatgtttgttccagatgtgctatgggcaaaaatagttaccgttgtagtgtgtgaaggctatgttgtttttatagtaagtatggagattatccaaataaaggatgagctaaaggaagatatgttaaaaatagggggatataaaattactcccaaaggaagtatttccctatttaaagaaattgattttaagattgctcaaacagagtattcttatacaatattgatttctaagaaacctttaaaatggctttataagaagttttatgttacaatctatggaagacatggaaaagtaaaaaagattgaattggttcgagcagacaaaaagtattctacgaaatatgagacaatgaatggtacagtcttagaaaagttgcaagaagaaaataataggtttttaaggaaatgcttaggtactcccagtaaaaagagtatgacaggcgtcgaatattattatgagtggggacaaatacaatccttctatgatgatcgttcttgtcaaacaggaattgtaattatgttttaaaataaggaatattgtatctcttgcttccgtatgcagaaagattacatcggtacagagaaatgtggtagtgatacaccaaagaacacaggcgaaaccttatatctcggttccacaagtagcgaatctttcaaaagagagagatgggtaaaacttcgctgtttatataatagtaggggacgatgttttatcccctgctattatacgttttttagcatgttttcaccaatattgcttggtacctaaccgatttttcaaataacatctgattccaagatatactccctgagaaagtacgaaaagcaatagaagatttacggaaagtgcttttttaattgcttctccaaaataaatgatgacagcagtacttgtcagtatcatcagtagagtaataacatcccaacagtttttcttatataattctataacctttatttctatcagtatcgccagtatccctgtccctgccacacatattccgacaaccaatatcagaaataaccaatataccattccggctataaaaggatttggaatttttgtgctaatctgtgccacagattgcccggcatcaattgtccaaccgataaaagtttgtaggaatgacgctgcatcatggaagaatgatttacaatcggaaaggaacacatcggactgtactgcctgaaaaagagtggttgtcagcgaataccatgcaagaaggaacaaggttgtttggaacattaccgtttttgctttatactgtccggcaagtcgctctttttgtgttccgtatttcgctttttcattctgataggctgtccggtcacaggattcacatttttcatagagtaccggcttttctaccggtatctctacgattttctgatgtgtccgggcataatcccgttgttgtgttaaacagcgtattttattttgatattccccgatcatgacgtttgcgcttcgcagcttctctttctcgttccgcaatgctctgtctgccagcttcaagtcgttctttaatgcttgaatattcccggctctgttctctttgtttaatttctcgttcaagatcagagattcgttgagctgcgtcttcagttccacgataagctggtctttctgttccagttcttcttgtatctcctcggtcaggagcagaagctcttccaactgttcggcgttctttaattctctggattcgttcatctatatcacgtcctttctctatctgctgttccagttcagcaattcggtgttatcctctgctgatttggtcgtttcaatcaatacgctacattcttccatcgtaattcagccctttctttttaattttgaatatgaaaaaagcagtcgatcataaatgaaaggctgctttaaatcatatcctttattgctttgtgtggagatttaactgattgtctatgtcccgtccggcatacattactctaagtattgttacaacttttttatcgctgtctggaatataaagtaccacataattgtctactggtaatacacgaagtccacgacttttccacggttctttttcatattttcgataacgctccggcatcgtatccagacttaatatctgttcttccagacggtcaagctgtccgcttgcattttccggcgattgtaattcaaaagaaatatattcaaaaatccctctcaaatcactgtcagcctgttcggataattctacttcatatatcataagccataatccttgcgaatgtcagcaaatgctttcttcgcattttttgtccgtccagcctgcatatccgcatatcctttctccaattcttcattgaactctgcttctgataatgtgctgatatcaacaggtctgtcagatggtatttttacttcaaacggaagtcctctctgtaagataatctgtttataaaacatattgatagcactggaagcagggataccaagtgtagacaggatactttctgctttttctttgacatctggttcaatccttgcatataaatttgctgattttgtagccatataaaacatctcctttcgtgagtagtatttccatctatctttattatatgcaaatgtccgcacaatagcaatactaattttatgctccaataatcttattgaataactgtaacaatacatcttttacgccggacgcattgaatacaagaccaacggctactaaggcaactaccaagaatccgataagtttggaaaactcacgcttacaggataatcgaactactgcatactaaccgccacagggaactcctaatcccttgctcatgaggggaagaatagtttatcatattgtaaaaaaatataaaaaaatataaaaagtttttgtgtttttaaatgatttgttaaggttagttgtttatatatagagaagaataattaagagaaaagtgatggatatgatacaagactggatgataataaacaaaattaagatgggagatcctgatgcatgggatattttagtacataaatattatgatagtgtgtatttttattgtgttcgcagatgttatggagactgcgatatagcttctgatttaacacaggatatttttttaaaattggtagaaagtttacctagataccgattcataggaaaatttcaaaattatctatacactatggctgtcaatacttgcaataattatttgaaaaaaagacatattgagcaaatagaactcacagataattttacaactgatttagacacttcattgattgatgaaatattacatgatgagagaaaagaaacggttcaaaaagcacttgatttacttcctgaaatacaacgagaggttgtgatactacggtattatcacgatttaaaggtaaaagatattgcgacaattactggcgtgggggtatctactgtacagtcacgtatttatcaaggccttagaaaattagaaaaagttttagaaagagaggaattttatgatggataaaaaagatattatatcgaaattggctggttataaattagaaggtgatatagaaggacgtgaaaaaaccatcgaattaggatatgaaataatgattagacttgaaatgagtcgacattcttactttgagctattcctgtcaacttttcgcttcatacatgttcatacttggataattcaattattcatctttctatcagggataactatggcattaaattttaaaaatttacagccgataagtgaaataatgttatgcattacaggtgtaatattcatttcggctttattttttttagatgaattattcaaaagttttactacaggaatgtgggaattggaacagacattcaaatatgatttgcgacaacatattatgatgaaattattgatttttggcattattgatatggtaattgttattttgctttctcttatgactaaatctatagtatctttgcctttgtatcagatattagtctatgtacttgttccatacaatattgtttgcattattttattttcgcttataactatatggagaaagcaattacataattatttcctatggtgtatatcgggaagtatttgtgtcgcagttattttaattgcaaatatctttaaaatatatgaaatccgaatgctttattggggaatagcatatttcattacaacgacaatattagggattatcttatattctcaaactaaaataatcaaatgggaggtagcttcagtatggaattaactattaataatataacaaaacaatatgggaatgtaactgtgcttgatgatgtgtcgtatcgatttactcctggaatttacggaatattaggtgctaatggggcgggtaaaacaactttatttcgtattatttgtggactgatgagagcaaattgtggaaatatacaatatgaccataaagatattgctctgcaagcagaatattatcgctcgattcttggattcttaccacaagattttcgatactatcctgattttacaggattaaattttatgatgtatatcgcttcattgaaaggcttaaatgggaaaatagcaaaaaagagatgtttagatttattgattcaggttggcttagatgatgtgaaaaataaaaaaatcagaaagtattctggcggaatgaaacagagactaggtatcgctcaagcaatgattaataatccggaaattttaatattagatgaacctacggtagggctcgatcccaaagagcgagttaaatttagaaaactgataagttcgtttgcatcagaaaaaatagtattattgtctacacatattgtatcagatatagaatatatagcagatgaaatcattattctaaaaaaaggtagaattgaaaatacaggcacaataagatatttgttgaaagatattaacaagtgtgtatgggaatgcctggttccagaaaaagaagtaaatcgaattgagcaagtatatacagtaagtaatcgtaaatatggagaagacggagttgttcttcgacttatttcaagggaaaaaccttttgcaaatgcgaaacaagttgatccggttttagaagatttgtatttgttttattttagagagggggaatgagagtatgacatcgctaattaagtttgaacttgggaaaatattgagaaaccgaactgtatttggtgggattgttgtaggatgcttagtccttctggggattttttttgttgggtatcactattcacagctatcaatgagtgaagcgagtaataagaaaaaggggtttgaaaagagcctcgatgtaataatagatgaaaaatattctggagagtttacagatgaaaaagttaaaatgattctgtctgattctatgaataatttccaagagaatgaagagcaaaaagttgttaataagcctttttatccattttattgggaaatgggagatacttttttttcaaaagatgccgaaaatgtttattcagaaatgattgaacaggttaataaaggccaaagattaacaatagaagacgtggatttatattcattggacgaggttggatttaaaaaatttgatactcctttgacattaggaaattatgttccatggacagacttatatcgagtacttggatatatatatgctcttttgtccataattacaatattggtatcttccatagtgttttcagatgataattctaaaaatatcaatcagattctgttagttacaaaatatggaagaaacaaaatgatatttgctaaattgattgcgacaagtattattacagtgagtttatttattatttttcaattggtcaacataggtgttttctctacaatgtatgatatgagcggatggaattcagacatacaaacaaatttgtcgttgggattatttgacttccctttgcaatataaccatattcaaatatactttttaattcttgtcatgcaattagttggtattggatttgttgagagtgtaacattgttaatatcagctcttatgcattcatctatgtcagtattagctgtttcattaggggtatatatattaccattattgctggtgcaaatgataaaaacaggggtaggtaacaaaattttgtatttgtttccaataaataatttgaatgtacaaaatatattaggtattctatattcaaaagatgcttttttcttccattccttcttcattaatataggatttatatttatttttcagctcttaatacgagtagggatgcaactatattgctttatttatattaaacattggaagttttaatgattttttcaatgaaaatgcaattgaagaaaaaatatgatatcatgtgagtaacaaatcgggattgaccgagttctttgagtgagatacacttcttggacgaagggaaggaagaagaaaaaagtactttagaggtattatggaatgagtaataaattggttaagcaccaagaaccaaaagaaatattaactggaaatcaaaagaaaattttgttttggatttgtttcattattttaagtatagctttcattacagtctggataaatatacttttgacatctaaagcatttaatacacaaatggaagagatggtactgggagaagattactatatggaggatattgtgattacaggtaaaagggctgaagctgcttcggctgatacgatatctcggaattatttcttctactacaacaatggaaaagtgaatgattatcacaagcgaatgcaagtaccgggatttgtatattcggaatataatgtaggagattccatagctgcatataccacagaccatgttagttattcttattacaagtatgggattcttccggatacagagtatacaaacaatgaattaatgaaagtggctggcgtattgcttggaattggaatatttttattggctttgtttggggtattaagtaagaaaatgaattacaagaagtaaccaacttcccgtttattgggaagtcgcagagaacgaaaaatcggtatttgtggggtggtgaatatgaaaaagaaaattttaaaagcagttttaggtattcttatttgttgggggatttttgttgctattgagggatttcgtttgattggaagcactgacccaggaaaatgtccgcttataacacttggaagcacacaaactgcggatgaaattgctgattatggaagtttaggattttcacaaacatatcatctgacaaacggcgatgcatttgtatatggtgaatttcgagtttggggaatcagaattgcaagatgggagagttaaattctagtttgttgaatttaaaaatgaaataaagttccagtaatcatagagtgtatggattcaattccatatgctctttttctttacttaatttcatgaaaaatgtaaaaatctaatgttacgagttgcattaaagaaaactcgtaagaaaaaagtaaaaaaatttgcttttgaccactgtaaaacatgctctgagcgtttcgttatatgaagggataatttttctttcatatttcaaagaaaagaggataaagaaatgtcagaaaaaagatgttatacagttcaagagttacaggaaatcttaggagtcagcagacctactatttataaccttttaaagaaaaaggaattccggtggatccagttggatggcggaaagtatcgcatctctaagaagagtttcgatgactggctcgataacttggaacaataaaaaacagggtgttgatcaggcagattttgtctgcaatcgacatcctaaatttttatctggatttgagatatgatataagaaaaaaaactaacactaaaaaagacaggaagtgaagaataaatggcaacagcaattatgaaacaaaaagaagttccggaaatggacgatgttgaagagatcatttcaaagatatcagaagacagtccttacaaacggcgtccgacacaaaagagaacctggatgaccgtgccggaaatgggaaagctgctgggattaaaaaagacagatcgatactggctggtgcataaaaatgtttttgaatctaaagagattgctggaaagatacgaatcaatattgccagctttgaaaaatggtacgccaatcagattaaataccataaagttaccggagaagaaccagggaaagaattgaaatcctggtcctattccgttaaggaagttgcggatctgttgggtgttgatgagtatcttgtttatgatttactcaagaaaaatcaaatggaagctgttattgtcgattactggaaacgaataccaaaagaatcttttcagaactggtataaaagccagtcccggtatcgaacaaaggaagacagaaaaaaagacgctcttctggaagatgcaacaattacgatgcctgagatggcacagctgcttggaacaaccagaagcgcagtatatacaattcttgataatccaaagtatagtcatttttttgaattcattgtgattgcagaaaagaaaaggatcacaaaagagagttttcgaaaattcctggaaggtcaggatcggtataagctggatccatcgaatgattatgaagaacttgcacaggaacaaaatattgccctggctaatttccggcggaagaaattatcacagaccggaatacgaggaagcaatggaaatataaagtatcttacttttgatgaagcttcctatctggcaaaggtcagcagaagcatgatcaacaagtgggcggataaaggaaagttcacagtaataaaagttggcagtcgagttaggatccgtcgggatgaatttgaggactggatggagcaaagagatttggaaaggagtatgcaataatatggcatctataagagaacgaaacggaaaatttaatgtaatctattcttatacgaatgaaaaaggtgagaggaaacagaagtgggaaacctatgaaacgaaagccgaagcaaagagaagaaaaaaagaaattgaatataaaaaagagatgggatcatttgtcgtccgtaaatgcaaaacactggacgagcttattacagaatatgttgcactttatggcaaagaaaactgggcgctttctacatatgaaggaaatgtctctcttatcaataactatattcttccgatcattggtgatacgaaactctcagaga

SEQ ID NO: 445 - DNA, 22396 bp, Eubacterium hallii
cagcagatttttctatctccccatttttgaatttttccatggcttctgaagtaaggttattagaaatctgcttatattcctgaattgtagaacgggcgattcccatttttcttgacagacgttcaatcattcgccctttttgtaatgactctgggaattcctctggatgttcttttaataatttttctgttttaagaatctcgtgcattaattcataggcttttttctgatgataaccattagaagctactacttgaaattcttcctgtaccgaactaagattacttaccacacatggcagaaaagaaaattgcttcaagcctctttcttctaccagtaacttacaggctttgcatcttttatgccctgcgatgattcggtactcatctgtatccagtttggatacagacagattttgaatcacctcgccagcagcttcaatcagatccgccagtgcttcaatttcttctttgtctctttcgggacaatactgccccggattttcttttaattttgtatagtgaatccacttaatcgtccttcgtggatgctgttcttctttctttatatcctctttattattaaatacgtttccaagccttgccataacagatacctcctagtcctcaagaagttcatctaccagatccacgaaatcctgtgctacattacttccaccacgatgttttgctactggtttgtagagagataatgcgttatcaacaatcgctgtccggctgatacatgattgcataaatggataatcatgttttccaagcaggtcggcagaagatactttctgtgctttgacatttgccaccatgttcgcaaataccttccattccagttccggatttttttctttcagttcatggtatgcgtcctccaccatcgtgaggttatcacggcaaaagttatcaaatttcacaggtgttaaaaggacatctgcggcatataatgcgtttttcgtcaatacatcgaatacaggacgggtatcaatcaggcagacatcatattccttcttaatgtatcccaatgcctcttttaaactccatggtgatttctgttccaatgtcttaacggaacctttaataatatcaatatcttcatacttagtacgatagattgcactattgatatgttcaggggcttcaagaacgtctttaattgttttattatattcgtttacttttgcaaaaaatcgggtgcagttacactgtgggtcaaggtcgatcactaatgttcttcctcccatttctgcataggtatacgctaaatttacagttgtagtggtttttccaacgccacctttaagatttccaattacatatactttcattttcattcctcctgagataaactcaaactcttttgttactgattttcattttctaacccaaaagaaagttgtttatatggcgaactatcaggagttacggctttattcttccttacttttttttgtgatagcgacatttttaaaagattatcatttgaatacctgctctcatacattacctttatgttatttaagcttttattcactaatcggaaaaaggtacgggacgtttctcctgttcttgctatgtaatctgtcattacttctttagacgagtgatgttccacatagatttttgtgacaacctcataacattcttcggaaataagctgataacacagccatactctgcgaattttttcatcctttttcatcagagactcaatttcataagaaatctcccgataccatctttttagaatacattcatgtcggataataatatctgaaaggtctttcttacttcctccttttgttcccatctcagatatttctgtttttttgatagatacagtctctatcagattatctgtgtccatcaggtcatcgtacaaatcagaaatatgttttctaatctgcttcttcaatcccttgtaattcgataagattgttttgatttcttccaatgaaatttctgtctcatttgtcatgatttttccagctccgattttgtacagttttttgccgttaatccgactattattgctatacaatgatatttttttgcatctactttaaaaccgttttctcaaaaagtcgcataaacccttgattttgagataaaaaaaattgcaaccagagattacttaaatctcttgttgcaattaaatatacactctttagttttccttgtatacatgctgacaaaaatgagcagatcggtaccgtaaggatgactcccatacttgaagcaactccctgaatgatttcgattccgatatcaaacatattgatcatctgcaaatattcataattataagcatagataaataccagtgtattaatcgaaccgcctgcaaaggcaagaattaatgtatttgacatcgttcccatcatatcttttccgacacgcattccagaaaaaaacaagccttttatccccagttcaggattttgataagatatttcttctatcgttgatgagattgacattgctacatccatgacagcacctaaagaagcaataagaatacctgcaatgaattttcccataataacctcttttctttttctttaggtctgttccttgctaaaatttaaaatctacgttatataaaatagcaaggttttgtgaggtctgctatcaaggaaaggtggaattctggtaaaattgtggtaaattctaattgaaacaaaacggacgaaacctcgaaatccccacaatcactattctaattcaactaaatccagccactgtcgctcacgaatttaaaatatattttgcatttctcgctttaccttgttttaataaaataccatcttctaccattttcttaagaatccttagggtagtagatgcgctggttcccaataatttctccgcatctccccttgttatttcgccattcattttgatatattctaatatttcactttccctattctttaatttttctgttttttcttctagctgtttatttagagtaatctgttcggataaaatctttttttcttccgattccatattgatattcggaagtataattttaaaagcattttttgtactttcaataacaggctgtgcttcttgagttttatatgcttttataatttttcgcattcctgttccatatgcctcaattaattttaaacggtaaaatacatttgccagattctgatttctacatacagaaagtcctatcataatatcttccagttccattccaggcactaatcctcccactgatacaaattctattctgtcctcataaatactaattaatgcactggcactaaaagaataatctcgatgaactattaaatttaaaagtacctccctcactgccacttctggataatctctgatatctgttctcagcaaaccattaatcgttgcatgtgtctgatttcgaaaatcaataaactcataaacttcattcatctgctgtaacaaagaacctgaaaattctcttctgtctttaaatacttcctggtcttttccctgaaaaacggcaactttaattgtatgaacacattggtctgataaaagtaatcctaaattgctataaataccctccttatctatcatctttaatatctgcatttgctgtgaaccaaattctatatctctcaattcaaattctttttgggcagcctcgaatgttaactcctgatttaagctacgcatttcttcaaaattgtctccatctgtttcttttatcatctgacgaattgccgaatctgttgccggaacagaagaatacccctgacgaacataaaccccttccggtcgtaagcctttctttgcaatataatacggtctttctgttcctctttgaatagaaacagctactacttttttcccatcttcttctaatgtctcatagtgtaaaaacatagttaaatccggtttaatcgcatcacgaaccatattactaatctgcagcgcaaccgaatcaggatcatcaagccctaccactgttccatcgtcctgcacccaatatacaatttaccgccattacagtttgcgaaagcgataatttcttttctaatatcatttacaacgatttcttttaactctactttctcacttccacgaaaaaccatgtttccctctccttttcttgatttatctaatcacatcatgcatgtttttcaaccgatttgtaggatatggtttacctcttcttttgtttttcctcaaaaatcttttccgctttttcaaacatttctctcgaaataatcggcacgtgatgatttttaataataacaaactcttcctcaccccggttatattttttctcatgcgaaagataatccggtgtaaatgtcttcttctgcacaagatccccacaatacttttcgttctgcaaaattcttaaaataaccgtatttctccatttttcactccgcatcgggtaaattccttcctctaaaagctccttcgcaatcgtgtgcgtactttttctttctaaaacaaatttataaaatatcttccgaacaacttcggccccttcctcattcacatacattttcccatttttcacatcataaccaagcatacttcttccaaagacaaccccctcctccatccggcgtttttgtccccatttgactctctccgatgttttccggctttcttcctgtgcaattgatgccataatcgaaagccgcagctctgcatctccctctaacgtattgattccgtcattcaaaaacagcacccccactcccaccttacgaagttcccttgtataataaatactgtcaagcgtatttctcgcaaaacgggaaatctcctttgtaagaagcaaatcaaacttaccctgccttgcctccgcgatcatctgattaaactgctccctcttcttcgtactcgtccccgaaatcccctcatccgcaaaaaccttataaaattcccactccttcttctcctcgatataacatcgaaaaaaatcgcactgactctcaaacgactgcgcctgttcctctctctccgttgaaacacgacaatatgccgcaactcgtttcttacccgaaaaaggtgattctccacaatatttctttttctgattcaaacactcatatttattcatattcataaaaatgaatactcctgcaaatgtagctctacccaatatatgaacatagccttgtctgtattccagtttcagtttcgtcttctcttctgatgcttctgtaggtactgaagaactaaatcatattgaaatggtctgcacgattgttcaccagctcacccgtaatctcacgatagaacagattaaagaacagggatttgctgattattatgttgaccatacaactggcatttatccaatcgctgcaagtggcactccatggagtgcagatactatgcagtctaccggtgacccgattacagatctgatggaggatatggctgcagaacagaaggcacgcactacctatgacaatatcctccgtcttgtaaaagatgacccggatgtttatgccgcaatcaaattcctgcgtgaaagagaaatcgtacactttcaaagatttggtgaaagtctccgaatcgtgcaagaccacttagacagccggaacttctatgcattcaacccggcttttgataataaaaagtgttaatttaacttgttgaaaaaagttattcaaacaataacgttatataaagtaaagagcaagccatttctcagcttgctctttgtcatgctactttttactgataaattgtatttcttacagaaaaacgtcagcaatttcttttttcgtcagattatcttcattctttattcacaacctgttcacaaatttccagtatcataaaaccatcaaaaacaacaacagatttttgatagatttttttatactttcctctcttttgaagccggctttatgtcggtttcttttttatctatcagattgggctcgattactcattctctataattttccctacctcctcaacttccatatctaataaatcacttatctgctctgccgcacatcctttctgatgtcactttcattatagcccatgttatatcttcatagcaaatacttttcttcaagccactccatgcgtttcatactcacagaacgcaagctggctttctatcgaaatactatcttttttgtctagtgactgccttgcatatagagcatcaatcggatatctaatctgattcatacaaaaaagcctcctgtacatcgtattaaaatcataagttgtcttatgacatctcatttgcaatggcataaaaaacggcgcaaatcacgtcttggatttacgccgtttaaaaaattttgatattaattttgtgataactccctgtcattaccaaggaaaaacagtgcgatcgtatcaggaccgacatgacttcctgtacaaaaatcataagaagtattaataaaatctcgtactttgattctttcttgtattttattcataatataaagggaatcttcgtaagcatcagcatgagcaataccaataatctgttgttctggatctacgatattattgcaaaccagattcaccagagtatttaaagcagatttacggccacgaacatttttataaatgacaatatatccatctttatcccctcttaatataggtttaatcttaagaacatttccaatcgtggcaacacttcccttaatccggcctgtccgggaaagatacttaagatctccaacagtaaacacaccattcatttttccgacatagctttccataacatccgcaactgcatcaacagccatacctttatctctcatctcactggcatatatagcaagaatcccctgtgcaagcgaagcattaagcgaatcgattaagcgtattttccggccattgatctccttatccattacttcttctgccgctaatcttgcagaattataatttccactaatatttttactcaaagaaaaatacaagacatcctgatctgcctgcaataccttttcaaactcttcttcaaaagttgctgtactaatcagccccgttttaatctcgcaaccctcacgcatggcattataatactctgtacccttctggcgttcttcttcaggcgaaagatctggattataacaggtaacctccttgcctgaaatcagattaacaaaagaaatgacatgaatgttatatttttttgcaatcacagctggtaaattggctgcggagtcaacaaaaatttgaaacatatgatactttgctcctttctgaacgttctatctgaaactgataccaataccaacgatatccggaccggtatggacactgatactgacagaaaacaaactgtaacccctgccccaaccgcatcaatgtgttaaaaaatatgcgtaaaaatagaacaaaaagttttgtaattattttatgattttaacattaaattgataatatttcaatctttctaataattaatatctgttttttaatactgcttttatataggataatttcgtttgtataactactctttggtgaaagtctctgaatcgtgcaagaccattcagccgctaaaacacatttttatgctgaattgtaagcgaactaggataaagaaaaaaagaattgttacgtattacattttgtgactttgcgctgtggaattttgactctgaaaacttcggactcgtttttccgaagttttcgttttttgagacaaaatgaagcgtttagcgcaacagaacaaaatcaaacgtataacaattctttttttctttcgaagaccgactacaattcagtaagaagatattcctcttctggagattttcactccaaatacaaaccataaacttctggacaatccccttattcccattcaagatttaactactaattttcatctggcgccaaagaacagaaaaccagaaatttgagatagaaaaaatgtgatgtcggagctagtaaaaatgccgaacaggcattttctacgccgcgactatcttcacattttttctatctcaaatttctggttttcgtctctttagtctagcaaattagtagttaaagatattccatagtgttttaaatcaacttttccattttttacttccacaccatcttcttccaaacgttttgcctgctctccttcccctccaaatacaaaagcctctgcaagttctcctttggagtttaccactcgaaaacaggggattgtttccggatcaggatttttatgaagagcatttccaactgcacgtgacatctttggattgcctgccatagccgctacctgcccataagttgctacatgaccttttggaatacgtttgactgcttcataaattcgttttgttggactgtctgttatcaggtcataactttctgtaatcattcgtttaatttcttttacaggtattgttccatcaagtattattgtattccagtgctttttattttgatgatatcccggaatgaccgatgggtatacttctctccagaaatctctccattctggttctacttttacatttaactgaacaaatctatctttttcatatatccataaaaatacttttttgctttcttttactctgatgagctgccagtttggatcgcgaaacggagcatctacatatgtattgggaaaggatagaccatattcaattgcttcttttcttgtaatcatacaaaattctccaatattttttttcaggaatacctcggtattcttagaatctttttgttcctattttcattctgactgctcccacaggcaagcctgtggggttctgattatcaagtgtagcttgtaatcgtacaccatttgcaggctttggagttacaagtgtaaatctatttaaatcaggattttcattaccaagcagtccaacgaccacattaacggcaaaattctgcttttcagcaaggaagtacagtcaatctcccttattattaagttattaagctattttaattccgctgtttaatactttaatcttatgagccttaatccacgtgattagggctttttctttcttatagcaattatcaaacttggttatacatttgtttttatctatattctgtatcttatagtcgtaacagtaaagcaggaatgatgaataccaatccctttgtacctcagtaccatcttgtagcttatataatcggtcagatagtttctttttgatatagtcatcaacagtatggtcgtactgtgaggctctgtaattatttggtacttctatatatgtaccaccagtcgtcttaaacttcttttccactgtagtctggaacccagaggggcatcggttctttatggatttaccaaaacgcttcttcttattgaacctgcctttgtcattaaccgcagtttctttcgctcgcttcataagtttgctggcgtttttaggttctgtgacaaatgtatctccaagacttcgtaaatggttagcatcttcgtttattgcaagctgtctgttcactgcattaatacggcataattcagaatgttttgctttcagtttcttataatgatttgaatatttccaagtcttacgacctttcttaaccgtaccgtcttcattgtagttttgtggatttgctgctcgccttgacctgtccatagcacgatagagcagacgttcttttctttcagaagtctgtatgctgttgccacgctctgaaagattctttaaaccaacttccgtatcagatgtataagcaacagtctgtgtgccaatatcggcacctatcacccctttaccatacttgtgacgaggattgccatgcttatcatactttagttttgttttgccctcaatggtcagatgcaaatataccctgtatttacctcgtatcatcttaataacaagagtggcatagcaaggtctgtatgtgtctatgtaataagcgtcttctatgagagtatttaccgctttgttattcacaatctcaggttcggcaagatatgttaaaacggcatctgcttcgtcctgttgaaatctgtcatttacctgtattccgaaagcggttttgccaagtttggactgcaatctgtcatcttttacagatattggaatgccacgatttatctgttttgctcgaatgcaaggcagttctccatattttgagaaatgaatagctttaccattaccatacaagcatttctcgatacctcgccaaacatcctccgcttttgttaatgcaaatacagcatcgattccatatttcttgcctataggaatcatagattttctgcaataatcccatgtgacattataggctttctgcatttcgttaagttgatcagctaaatccttacgtttctttttatccttggtagaaccatagagttttagcaacttgcgatattttttagtacgtataagttggtcataattctttctcataaaactaacaagctcattacctgctttgcgtatcttatcagaaagaatcacaactttaagtgcatcggaataaggcatatcggtctcaacaaccaaaatatgcctgtcagaaagtttatgaaattgttttaggagttttttatattcttcatcacttatcatttttctgctcctcgatatacttaattactgtagcttcacttatattcccaactgttgacacaaaatatcctcttgaccatagaacaccacatttcgcatagaactgttttaattttgggaatgctctaaataattcgacagcactgatactttttagggttcttacaacatcacagggagcaaccgtctgcggaacatctatgaaaatatgtatatggtcaggcatcacttcaagtgccttaatgtgataattataatcatcacagattttctgtaatatctgtttcaaggtatcctctacattgccttttaataccgaaaatctgaatttcggacaccagatgatgtgatactgtatcagatatttacaatgtgatgctgaatgatattgttcctcactcatgagcttgttctccaagttgatatttttcctgaatacctctacgcatcaaatcaagaaatgtgatagtttcaccctcctcgacagaatagatacgtgcaaggttttcaagttccgctttccactcagagggaatagatatattgacttgtacattatttgattttatccgtgccataatattctcctaattataatcttcgcaacaatattcttcctctacaatttcttcatcatgaaccatgcaatgcaaaatatcatttccattatctgatggctcagaaaaagaatttgcacaattcaaacaatcttttggacattcatatatatacttaaaattcttttttatattaagcatagattatatatttattctatgcttaagtcaagtcaaaaaaagtggctttcatcccacacgcagcatgtgggtttttcgccacaaatttataacatactcctgctaaaagagacggtgtgtttttagatgacagcaagtgctatgaaaaattccgggacattcttgaattttttattaatcaaaacttttttctccatttttttacttctatatgttataatcaaacagcagactctgcattttttcgctatgcagttttgcaatgtatcataagcttatatctcaaagggagattatgaaagcatataaaaatatataaaataataagtgaggtagaataatgaacaaaatcaagattggtattgtaggttatggtaatattggtcgtggtgtggagcagtcaattaagcgtaatgatgatatggaattggcagcggtatttacaagaagagatcctgctactgtatctattcagacagagagtgctgctgtgaagcattttgatgagatggcatctatgaaagatgagattgacgtaatgattctttgtggtggttctgcgacagatcttcctgttattggtccgaaagttgctgcttcttttaatacgattgacagttttgatacccacgcaaagattcctgaatattttgctgctatggataatgcttcaaaaaaaggaaataaaatcagtattatttctgtcggctgggatcctggaatgttttctttaaatcgtttgtatgccgagtccattcttgtacagggaagtacttatactttctggggcaagggtgtaagtcagggacattctgatgcgattcgccgtattgaaggggttaaaaacgcaatccagtacacagttcctatcgaagatgctgtggagcaggtaagaagtggaagtgaaccagaacttacaacaagacagaagcatttaagagagtgctatgttgttccggaagaaggtgctgataaagcagctattgaaacagcaattaaaacaatgcctaattacttctctgactacgatacaactgtaacatttattaccgaggaggaattaaaggcacatcatagtaagatgccacatggtggtttcgttatccgtactggtgaaacaggatgtgaaggtaacaaacatgttatcgaatactctttaaaacttgattctaatccagagtttacaggaagtgtacttgttgcttatgcacgtgctgctcacagactttctgtgaaaggtgaatctggtgccagaagtgtatttgatatcgcaccggcaatgttatctcagatgactccggaagaattaagagctaagatgttataatcttatatattgatgtcagggtcaaaaggtcaaaacgccgttcgtgcttgtacgataaggtgtttgactttgggacccgcggaacatgagaaagtagcgatttacgtagtaaatcagcggatttcgaatgtttcagaattacgggagctgcattagctgcggagtaattcgtgacatcaagttaggggcaaaataccttttgcccctaacatcatatattgaaattcaaggagggactttaaaaccatcatgccagtatttgattttagtaatatgcaggcaaaaaaagagcctgtacgctgtacatacaccatggtctattcagataatgatcatgcttcaccggaaaatccgattcttataattgacaatacaaagagagaatggaaacatcattcttttggtatttttgcaaatccaaataaacagactacatttgagtttgaagaagaagatgggacgatcagtgcagatatcttaaaagtagatgctcgttttgtcagtcttttaaaatggcttggcgaacaccatattcacatccagctttccggtaaaaatactgcacaaggatatgcagtctataaaattcaggaaatttcttttggaggaagaacgaaattatctgcagaagatggctttttacagtttatgatcgagcgtctttttgcaagcagcgctcctgtggaggaaacttctgagataactacagaggaagaagacagtgatgagatgaagcttaccagtcttcagagcattacagactttatgacttgcgccggaagaacgcttcctgataatatccgcctgtgggccagaagaaaccttgctgttgcccgttcacgtgaagtttctccggaggaacgacgccatgcccagcgtgctttatctattatgatgaacatccaatggaaaagtgattattttaaatctatcgatcctgaggaagcacgacggattcttgacgaagaactctatggaatggaacgtgtaaaacagagaattattgagacgattatccagattaaccgtacacatactcttcctgcttatggtcttttacttgtaggacctgccggtactggaaagtctcagattgcttacgctgttgctcgtatcctaaagcttccatggacaactttggacatgagttccattaatgatcccgaacagttaaccggaagttcccgtatttatgcgaatgcaaagcctggaattatcatggatgctttttcaatggctggagaatctaacctcgttttcattattaacgagcttgataaggcaaactctggtaagggaactggtaatcctgctgatgttcttctgactttattagataaccttggctttactgacaactacatggaatgtatgattcctactgttggagtttatccaatcgcaactgccaatgataagagtcagatcagcagtcctttaatgtcccgctttgctgtcattgatattccggattatacaccagaagaaaagaaggcaatcttctctaaatttgctcttcctaaagttctcaaacgaatcggcttacatgaaggggaatgtatcatgacagatgaggcattagataccataattgacatcttttccgatactacaggtattcgtgacttagaacaggctgcagagcatatcgtagcgaatgcattatatcagattgaagtggatcatttaaaacaggtcgtttttactggagaaatggtaagagaattgcttttataactttgattcattatgtaaaaagtccgatagatcagatataaggagctctgctctatcggactttttattttttatcttatttcatcttaaatgcagcttttccattctgttttatatcgtagaggacagcatctgcatttttacataacgatacaaaatcttctccctgttcagggaaaattactcctcctgcgctggcatacaattctactacctcacctgtcgaaagggtaaaatgagaaatcttcttctgaaagctttccatacaggcataaaccgtttctggtttgacatttttcagatatgcaacaaattcatctccgccatacctgccgagtatactgtctttcggaaaacactcctgcattgtctgtgcaaagtatttcagacaaaggtctccattactatgaccataggtgtcattataagatttaaaattatctacatcgataaacaggaatatccctggttgtttctttctaagctcatgttcaacatctgcccggaaagctctgcgattcaggactcctgtcaatgcatccgtactggacagaccaatatatcgttttttatcttttcctataacatcctcttattttcatacatcagcttatctgcctgatggattgcttccatgatcggatgcacaccgcagaccccaccaatactgacggttacatgaaaatccggatattcggtaaacacaatattctcaactgcttttttaattttttcattcttcttcaacatatgtttttcagacatttggggaaaaagcagcaaaaattcatctccaccataacgaatcagaatatcggtacttcgaatgcaggactgaatcgcagcagcaatatccctaagcactacatcgcctgccaggtgtccgtatgtatcatttacctgtttgaaacggtccacatctataatttctacacactccatcccttccatatgagtaagatatgtctcaaaatatcgtctagagtatgcacccgtcaacgcatcagaaaaaagttctctattctctccacgacttttatccagtaaaaatcgggttccattcgcatcaatccagcgcccttcattcatcttagagagcatctccagcacacatggtgttccgttgatgcaaagatattttgcaacgacataatacatatctcttctggtaaattctaacttattcagcatcgttttctgtgtgagggcacgcgctgaaatacagttggcacaatttcctccgttctcccagaaaccggcacagtgctgatccgtctgcctcaatattcctttatcatctacttccatgactgcattatgagtcggatctaccagacggacaatatcaaaaatctgcttaagctgttcaaatgctgctcttatatcctttccatctacgttctctcctttagaaagaccatccagaagaggaagttccgctgtaacatgctgtggtttaattaactgccccactgctccaatataatgatctggtgacgattctgaccaaagtgaatgcattcgcagctcacgccactcatagtcatttccctgtggtaacataatactcatggaaaattcccgattttccggtgtcgttgcatccagcgcatctttcaagcgatgaacatctttctgccccagatatttgaaacaattctgatctgcaagattcatgacagaataacgatactgtggcggttcattccagtttactatattggccaatccggaaacatgatcatactcaaactgaatcccgccatttaaagaagcaaaaaattccagccgttcctgcatagattcgagcatacgctgtgctcggtcgctatatggcatactttttttcttcatcacttctgctgccagacgatctgcctcctgccgatatgtttcttctcccatatctccctccactaccatacgaagtttgggagatatttcatacaggcattttaagagaagcggattaaaagccccacattcaccagacatgatcatattcatcgccgtttcatggtcataagcattcttataacaccgcttactagtcagcgcatcgtatacatctgccaaagcaaccacctgggctgaaatcggaatcttttctccgagaagcccatccggataaccatgtccgtcccaccgttcatgatgccagcggcagatttcccatgcactgcgaatcagcggtttttctgatttcataaacatctgcctgataatatccgcaccgattgtcgtatgtgtcttcatggtttcaaattcttcttgtgtcagctttcccggcttatttaaaatactttccggaatactgatctttccgatatcatgaagggcagatgccgttgtaatgatagcaatatccgactcagacaaatgatattgatctgttttctgaaccagacaacgcagtaaaagttctgttatcatgcgaatatgaatgatatgttctccgctttcactgtttctaaattccaccgcatggcttaaaataccaatcatcagattgttattctcttctttttcgtaaatctgatcagagaccatctgctttaatcttttctgattcgcatataaattcagtatattctgcacacgcctgcgtacgataaaagcatcaaacggtcttcgtatataatcttctgctcccaaaatatatgcccgctcaataatatctcttttttcttccgaagatatcatgattaccggaatctcatcaatccagtgaaacttattcattcgctctaacatctgaaaaccattcatttccggcatattaatatctaaaagtatcaattctatcgtaagatcatgttgcagcatatggactgcctgacagccattttctgcctgcacatattcatatttatccccaagaatcgccatcagaatctgacgatttatttctgcatcatcaacgatcatgatcttttgtttcattcccatgtatattagctgtctcctttccctatgttttttacatcagcggtctatccgtctccctaccaagacagatccataacaacggcaaagaaaaaaacacctgactatttataccttctttcacttttctcccttttatttaggcagagtatctttatactctgagtattttccctctttcagaaacttcgaatatacttcataagctttctttaacgtgttatattcttcaccttttgtatatgttttaaaaccattatcattataaatatgatctgcgattgcaacataattctctttatttttaggatttctattagctgttgtcgtttccgatatataaaaaccaccatttgctttgctgacaattactggtattttcttttctgccccaacctgattcgtatcaacagatgtccaaaacaaatatctgcttgaatcttccgatggacttccaagataggcccatgtaccatgtttcagcagactattatcttgttctttaatctgtttatttactttattaaccatgtctgaatcaggacatttggaatctatctcaaagcgtgtattcgactgatttattaaattctctaatattcctgttcttttaagtattccatgcagatcttcgttaaaatctatcgttgtgtcagatgaatctttgcctgtgcctttccagtcaaaaagaatccccgttgcttcattgtaaggcacctaacattccccatttgcaacaggaattccctgctagttatcagtatctttctcgcttttgtaatgtgtttttcctgcaattacaacaggatcaaatgcctgccagtcatttctcttttgttttaattttacgaccttaactatattcgatgcatcttcatccatcacttctgccataatttctgcatatgctgaacggacattcgcaatatcaaccgtctcgcggctcttttccacatgtctggcataagaaggtgctaataacgcaataagaacacccataattgcaactacaattataagttccaccagagtaaaaccttcattcttattatgcatttcattcataatgcaccactctccttctcttacttctttattacctgtttatctaactgaaaaaaagcactgtctatccagacaatgctcaaaaacgttgcaactggctaccattttacaggccctttagctttgcgtctcagactttcggctgatttgctacagttatatttctttattgccattataccttttttctgtcaaaatgtccatggtaatgttattattaggaacatttataaataaagttattaaaaaaatattcgctatcatcataaatgctataaactaaaaggacatgtgaaaaacaaaagtttctcacatgtcctttttagaactttctattattcacaaagctttgtaaattcatcagcaacaaactgaaccttcgttccgataattacctgaacagaagtctttccaggtttaataacccctgcaactcctgcagatttaattaccttatcatttactgctgttatatcctttacttcaagtcgcaatctggtaacacagttatcgatacttgtaatattctcttttccaccgcatccttcgaggatttttgctgcgatggcagtataatcattactttctaattccactttcttctctgcttcaagattgtcatcctctctaccaggagtcttaagatcaaacttcttgattgcgaaaaggaataccaaacatcatacataggaagaatccagacatgtacattccaagactccatgttacatctgcagatgtctcaccagcccagaagtgctgtaagtcaccaagtccgatcgtatcaaaccagaatacattgttcaatgcatgatgtaatcctgtaggaattaacaaacggttcaggaatgcatagatacctgctccaacaacatccatacctacaattgcctttccaagtgatacaagtgcaccgaaaagtaagtaattattatatattttacacaaatacttctacaatctcacaaataatactgtttctctttgacctatagtattataattgtgaagcgacacgattcttttgctcttttttgcactggtacatattacggtctgcaatctccttaaccacattgatatcctcaccagaaaataccgatgaaccaaatgaaacgattggtaaaaaagtaatttcctttctccgttcctccagtcgattcataaattcatgtaagcattcctcttctttttctccatttttcaataacacacaaaactcatctccacctatccgataacagtacccataacacgcataggcttttttgatacagtctgcgattgcagcaaggcaaatatctccttgcaaatgtccataatcatcattcacatcaaacactatgagaacccctccactgtatcgcatttcctctgtacgattcagataactgctctgattcaaaagacccgtaagaccatccagttgattccacatctcattacaataaataaaatacaacacagaaagcaaagtaacacataaccaagtaacacgcagttccggtgacataacctgaataatcgtctcggccgtcaaaaaaacaataagtggatagatgagcttcctgctgcgattttgaaattctctcgccttgataatcgtagatatcgaaagatacaaaattgcagtgaagtacatgataagataaatgcaaaaatattggccacgtgaatagatattatcagcatccacagaaaatacaattccatgtggaatagataaagccagaaaaatcagatatccaagctcacagtacaccgccatcttaaattcacgcttaaaagttgttttcttatccaacacatatacaagacagattgctactgcaggcgataaaccaaagcctagataatttgacatgatattaagccatcgataactcgatggcttaccgtcaactataagcgtgataacctccagaacggagattccagcaatcaacacaaatgcacatacaaaaccttgcttttgttttttactaagtgcttcactcaactttgtgagaatgcacataaaactcagaacaaaaagatcaattattgttaatacataaaaatacccattcattataaattattccattctttaaattactgtaattctaacagctaaactggttcttagcacaatacccagtgaaatttatccaaagaattttcccctgaaaattttttcttctcataatctcctcattttattttatcatccaaaaggacatctgttaacctgcttttttcaatttgaaactggaaacatccttttcctgttgatttactttaaataattttttacaaaaaatagatgtgtaagatttacgatcatcatacacatctattatatgtaatacctttttgcggattttttcgtctcccccacacactatgataaactaatcatccatttacgttttctaaaaataatcagtgacataaccaatctaaatatttcttctgtggttagcagcgtgtatacacctataattccccacttaaatacatatgccgcaaccaggcacaaaggaattccgatacaccatgtgccaataatatcaatcaccatgataatttttgtattgccgccacttcttataatacctccaccaagaatcatattttcaaccttgattggtgcatacaaggcaaatataatcagcaaaatttttccaagttcttttacactataatccacacgatataatctagtatagatacctgctaaaaaaataagcactatcgatatggctactgcaccaattaagcctgcatacataatcttcttagactctgtgtaagcctcatcatattctttcctgccaagccgcttgccaaccatcacaccagccgcagcagatagaccacttaatgcgccaacaatcagcccctgtatcgggcaggtaagtgtataggcagcaagatttaatgtgccgagatgtccatatactgccgattccacattttgaccaagactccatagaaattcactgaccaaaattggcatgatcattataaaataatctccaagactaatcttttcaaaatgaaatgccaagactggtttatcttcatctttttggatgcagaccataaatccgataccaatacataccaggttaaataactgtgaaatcagtgttgcgattgctgcaccttttattcccatcggtgcaaatccacattttccaaatatcagtaaacaattcagtcctgtgtttacagctactgctacaaagctcgctgcaaatggtatggctgcatgctcgttacaacgtagccatgcggataaaatattgctgattgccattggaatataggaaaacgccacaattctaaaataaacttcacccgtactaataatactcgtatcttttgtatatagactcagaatctgcgatgaaagaactcctgatgctaacagaaacattgtagctattattattccacaaataaagctcacatcaaaactacaccaggcttctttcgtatcatcagcaccaacaaactgtgcaattaaaattcccgcaacagtaccaacggcaccgattactacagaaaaaatcaaagaaaaattaccacatagcccaactgcagatatatttgtttctcccaactgcccgatcataacctgatctataattgaaaatgatgcctgcagcatactttgcaacgtgaccggaattgctattttacataacgatttcgtaaattttgacatcataacacccccgtactttctctttttattaatttaaccggcagcacaatttccgactcacaatctaatccatcccgcattgcttcaagacattctattgctgtttttgctctaaatgctgcatcctgatgaatcgtcgtaagtgcaggagaacttcccctgctagacatattgtcatcaaaaccgatgatctgtatatccgcagggatatgtaatcctttcccctgtaaaaaacgcataacctcaagtgcataaaaatctgagacagcaaaaactgctgtaatattattctttagcagttctgaaaagttatcctg

SEQ ID NO: 446 - DNA, 20780 bp, Eubacterium hallii
tgtaggtgcgatgccgggaagaattgctgaaggaatccgtcaggcaggcgtgaagaatccggtaatgcttttagatgaggtagataaagtaagcagtgattataagggagataccgcatctgcactgcttgaagtgttagatggagaacagaatataaactttagggatcattatcttgaagtgccgatggatttaagtgaggtattttttattgccactgcgaatgatctttctccaattccaaaaccactgcttgatcgtatggaaatcattgaactttccagctatacagagaatgaaaagttccatatcgcagaaaattatcttataaagaagcaaagaaagctgagcggacttacgaaaaaacaggtaagcatatccgaggaagttgtcagagaagtcattcactcctatacaagagaagcaggtgtgcgtaatctcgaacgtaccattggccagcttatgcataaagcagcccgtaaaattgtcgaaggggaaagagaagttgatatcaagaagaagtctttaaaagaacttcttggtccggcaccgtttgaagatgaggatgagaacctgaaaccacagattggtgtcgtgagaggacttgcatggaccagtgttggtggagatacgctttccatcgaagtaaatgttatgccgggaaaaggaaagatggagcttactggatgtatgggtgatgtcatgaaagagtcggcacagattggtcttagttatgtacgctctattgcagaagcatatggaattgacagcgactattttgaaaaacatgatattcatctgcatattccagaaggagctgtaccaaaagatggaccatctgcaggtattacaatggctctggcaatactttctgcaattacagaaattcctgttcgcggagatatcgccatgacaggagaaatcacacttcgaggtaaagtacttccaattggcggattaaaagaaaaattattggcagccaaaatcgttggagtaaaagaagtacttgttcctgcaagaaataaaagaaatgttgcagaacttgatgaggagattataagcggcctgaaaattacttatgtagaagaaatgaacgaagtaattaaatgcgctctgaaaaaagaatcaaaataacaaaaatgttgaagtatttttgaatatttattgtacacaaaaaggtggcaagcgatgaaatacttgtcatctacttttgatgaaaggaggaaaatatatggtaatcaaaaatgtaaatttagaaacggtatgcggaattacaagcaagcttcctaaaaatactttgccggaagttgcatttgcaggcaaatccaatgtaggaaaatcctcactgattaatgcacttgtaaacagaaagtctctagcaagaacttccggtcagccaggaaaaacgcagactattaacttctataatgtcaatgaagagatgtatatcgtagaccttccaggttacggttatgccaaagtatccaaagaagtcgcagccaaatggggtccgatgatagaaaactatcttcatacttctgagcagcttcgtatggtattcttattgattgatcttcgtcataagccaaccaataatgatgtacagatgtaccgctggatcttaagcaacggcttctccccggtaattgtagcaaccaaagccgataaaatcaaacgaagccagcttcaaaaacagttaaaactgttaaaagacactttaaaagtaatcgaaggcgttccaatcgtaccattttctgctgttacaaaagcaggaagagatgaaatctgggaactgatcgaggaatatgcgttagtagaagaataagacgaaaaaagaaacaatatcctatcccatctgctctgtagtcgctgtatttaagatgctcgtccacatcttaaacacgctccgaagccgcatctgggatagggtattgtttctttttttgactatctaaatccacagttaatgagaatggggattttccagaatccccttgttttttgactgatttgcagaatgaggttagacagccactgtaatagaactttttgctgaattgcaagagaaatatggtaaagaaaagataaaacactttacgataatagataatatctttatgcgaaatgtattaaaaggaacagaggaggaaataaaacaaatgtgtaaggaattggaagaaatgcgtcaattcttccgaatttagtttcttgggaaaccacaaccttctggagaatcccattttcaccaactgtagatttagaatagccagaaaaaagaaaaaaataatacatcccagatgcggcttgggagcgtgtttaagatgcggatgagcattttaaacacagcgactacagagcagatgggatgtattattttttccttttttcgtctcttaccaaatctacgaatcagagtttgtcagcagcaacatttccattaacttcccgtagacagcatcgcttttcttctcccagctatcgcagatcgcgatggcctgttctttggagacgacgttgatgcttagttctaagagcagggaacctttttctttaatctgtgtttttaccatatattctccccgtttctttttgagggggtaatagtcggcagtgatatccacttcttttcggagctggtattttttttcggcaaaataatcaagaatatcctttttgatcggttcagaaatctgggtgtggaacattgaaagtgcttcttttccggattccatgagatgatagtttgttgtgttgcggatagtttctgtacgtacaaattcagattctaccaattcgctgattgcctgttgtaaatgaaaataggatgtatatccatgatttacaaaaaattcgcttagctgggaattggtcagtggaaaatccagattatctaacataaacagtatcattaatttatataatgttaaagattcttctgacataggcttcctccctgcataaagtttcgttgtttcatttctttatgaatcgtatttaatacaagacgtttgtgtccgatccattttggagtgatcaggagatcttttgggccgtcaccggtaattcgttccacgacgatatcttttcgaagccagctaagacagccgatcaggtgatcaatatattcctccattgtgaggatatgaaatggatgttgtttataatattcagccaaaatcgtgttttttaatacatagagcatggaaatcttaatgccgtttattggaagagaattcagataacgtatcgtttcgatttccatatcggctgtttcaccgggaagaccgagaatgatgtgagcggtgacccggattcctgcatttgaaagagcatgacaggcagcagtaaaggtttctgttggataagcacgatttaaaaaggcagcagtatggtcatgtgctgtctgtagtcccatttcaataaatacaggctttcttttatttaattcctttagtaaagaaagaacttcaggagaaagacagtcaggtcttgtgccaatcgataatgcaacaatttccggagcctctatcgcctcttcgtaaagagcccggagacgttctattggtgcataagtgtttgtaaatgcctgaaaataagcaatataatgttccccatggtatttttcagcggtctgtgcttttccaagacgaatctgttcagaaacagagagggaagcgttctctgtaaattctccacttcccccttcactgcaaaagatacatccgccggttgcaagtgtcccgtcacgattgggacaggtaaaaccaccatccagacagatcttgtatagtttttctccaaaatattctttaataaaacgactgtaggtataatagcgttccatagaaactagtcaatatattctttgacagcagcgcttacaacatcagcaatctgtgggtcgaatgcatgtggaagaatattggtatcgcttaattcttcctggggaaccagaccagcgatcgcgtgagcagcagcaagcttcatttcagaagtaatatgtgtagcgtgaccttctaaggcacctttaaagatgccagggaaaacaagtacattatttacctgatttggaaaatcagagcgaccggtaccgacaacctttgcaccagcttcttttgcaaggtgaggaagaatttccggatcgggattcgccatagtaaataagatggaatcctttgccatagaacgaaccatatcctgatttataataccaggagcggatactccgacaaaaatatcagcacctttcatcgcatcggcaagagttcctgttttatgagaaagatttgtaacctgagtcatcttttcctgcatccagtttaaagaaggatcaccagaacacagtattccctgacgatcacaaagtgtaagatcatgaaaaccgtaagctaagagcatctttgcgatagcaattccggcagaaccggcaccatttacgacaactttacaatcttctttttgtttgtttacaacttttaatgcattaatgattcctgcaagaacaacgatagctgtaccatgctggtcgtcgtggaaaacaggaatgtcaagcatctgatcaaggcgttcttctatttcaaagcagcgtggagctgcaatatcttctaagttaatgccaccaaaagcaggggcgattctgacaacagtttcaataatttcttctgtatcctgtgtatcaagacagatagggaaggcattaacaccgccaaaatctttaaaaagggcagcttttccttccataacaggcatagcagcaagagcaccgatattgccaaggccgagtacggcacttccatcagataccactgctacggtgtttgacttgatcgtgtaagtataggcttctttaggattttctgcgatagcgcggcatggctcagcaacaccgggagtatatgcaatcgcaagatcttctgcggaagctaccggacatttggcttctacagaaagtttaccgttccattgtttgtgcatttctaaagctttttctttatttgtcataattatttccgtcctttcccagaatatattctagcatcgcttttcttattgtgcaatcaaatatttcacaaaaacaggttgttttcttcctaatctgtggtattataaaaaagataattctaattcgtcttaataatctgatgtgaaaagatgttttttcttggtatcacatcatgtttttagttataatcttttgatttcccaaatgatttaattgttattttttttatctcagtcgagaagactcccacctctttcaggtggctgctcgacttgaatagtatgtgaaaaatatccctgtcagtgaagttgacaggtgatattgaaatgaacatataagacagattttttgtggagccggcagaaaaatgcagagacattcttgaagtcggttgtgaaaacgtatacaaaacgtatttaaaaatattttagagaaattttggaggcaggaatggattttaaagaaatgacacttcttcaattgaaggcatatgcgaaagaaaaaggaattcgtgggataagtacgctgaaaaaggaacagttggtggaaaagcttatgaaaagcgaaaaatatgaagaaaagagagaagagaaaaaagaagagaacatagaagtaaagagagaagaaaacaggaaagagaataaaagagcaaacaaagaagagaagcgaaaagaacatagaaaagaacatacagaagaaagtaaaaaagaaaacagagaagaagaaaaagcagaggaaaaagcaggggatacaacagaagaaaaaaaatcagaggcagaaggtaaaaagaatgacatatccagcttagacagtggaaatatggcaaacggtatccttgaagtcatgccggatggttatggatttattcgttgcgagaattatcttccgggagagaatgatgtctatgtttcaccgtctcagatacgtcgttttaatttaaaaaccggggatattttagtgggaaatattcgtattaaaacgcagaatgaaaagtacagcgctttactatatgtacagtcagtcaatggatataaaccatttgatgcagcaaaaagaaagaactttgaggatcttacaccgatttttccaaatgagagaattaatcttgaaacagagaatgcaccattatccatgcgtatggtagaccttctttccccgattggaaagggacagcgtggaatgatcgtttctcagccaaagacaggaaagaccacattattaaaacagattgcaagaagtattacggcaacaagacccaatatgaaggttatcgttcttctaattgatgaacgtccggaagaggtaacggatatcagagaatccattgaaggaccaaatgcagaagttatttactctacgtttgatgaattaccagaacatcataaaagagtatccgaaatggtattagagagagcaaaacgtcttgtagagcataaacaggacgtcgtgattttattagatagtatcactcgactggcaagagcatataatctgctggttcctccaagtggacgaacactttccggtggtcttgatccggcagcactctatatgccaaagaagttttttggagcagcaagaaatatgcgtgaaggaggaagtcttacaattcttgcgacagcactcgttgagacaggaagtaagatggatgacgttgtatttgaagaatttaaaggaaccggtaatatggaacttgtgttagatcgtaaactggcagaaaagagaatttttccggcaatcaatatccagcgttccggaacacgaagagaagatctgctgttaacaaaagaagagcaggaaatcgtatatgcacttcacagagaattatccggcaatcgtgcagacgaaaatatggagcagatattgaatttctttaaaagaacaaagaataataaagagtttatccagctcatgaaacagtcattacttaaaaaataacagagaatcacgtaataccgccataattcgtaaacgacagtgattgacggacagaataatgtgtagtattatttggagcgaaacatttataaaaacaaatgtctataaaacaaatcaaattgaaaaggaagataagatgattaaacattatttaacagtatttttaatttccatggttccaatcgcagaattgagggcagccattccttactcacaggcagtaggacttccattgattccttcttatatcattgcgattatcggaaatatgattccggtaccattcatctatttatttgcaagaaaggtacttgaaatcggaaacgatatgccgggaatcatcggtaagttctgtcgctggtgtacggcaaagggcgagaaaggcggagagaaacttcaggcaacagcaggaaagggactttttgttgcgttacttttattcgtaggaatcccgcttccgggaacaggagcatggacaggaacattagcagccagtttcttaaagatggattttaaatccagtgcgattgcagctatgtgcggtgttttacttgcaggagtcatcatgatgacattaagcgcaggattttttacattgattcgctagataaaaggagtaatgttggggatgaaacggttaggaagttttttagatggaatatacggttttgacggaatgtcctgtttcttactggcagtcagtgtcattttgaacttgcttacaggactgtggccgtcacaggcggtgaataacgttaacttaatcagttatctgccattactctggtgcatcttccgggtattttctcataactacgaaaaaagagaacaggagaatgagaagtttttgcatatgatccgcccaatttgtgaaaatgtcattgaaaaacgagaagaaaaagccgaagcaaaattattccgcttttttaaatgtccgctgtgtaagcagaaacttcgtgtcccgaaaggaaagggaaaagtagaaataacctgcccaaaatgcggaaataaatttattaaaaaagcttagaatttctgattttgccgcaggcaaaggagatgcccaaaacagacgaacttataaaacaggattgtatagaaaatgctcagtagtcgctgcgagcaaaatgccttagtcggcattttcacgcgctccgagtcgcattttctatacaatcctgttttataagttctgtttgctgactgaatttttcggtgggctgtgctatggctggaggagctttatatgaataagaataataatacaaatggtatgcagaagataaattatcagaagttgcttgataagattacagatagaattaggatggaatgcgcggaaggaaacaaccgtccatccctttttcttcatgcctgttgtgcgccttgcagcagttatgtacttgaatatttagtaaagtattttaaaatcacgatattttattataatccaaatatcacaccgaaaacagaatatataaaaagggtaaaggaactgaaacgctttattcatgaagccggatatgagaatgatgttacttttgtagaaggtacttatgatccgcaggtattctttgacatggcaaaaggaatggaagatctgccagaaagaggactccgctgttatcactgctatgcactccgtatggaagaagctgctaagaaagctgcggaaactggagcagattattttacaacaacactttcaatcagtccgcataagaatgcacagtggattaacgaaatcggagaaaaactcgctgctcaatatgaggtgaaacatctgccatctgactttaagaaaaagggaggatatctgcgctccatcgcactttctgaggagtatcatctgtatcgccagaattattgtggctgtgtgttttcaaagaaaaatcctgatttgtagatttggtaatagacgaaaaaagaaagaataccctatcccatctgctctgtagtcgctatatttaagatgctcattcgcatcttaaatacgctccgaagccgcatctgggatagggtattctttcttttttctgactactctaaatccacagttagtgagaatggggattctccagaaggttaaggattatcggggaattaaatgctaaaggattgacgcatttcttctggagattttatctgaataagaatcgtagatttctggacaaccccctctcttttattttttaactgatttgtagaatgaggttagacagctgctgtaatagaactttttgctgaattgtaagaaaagaagattaaatacaattcaatcacatacaacaatttgaatgtcaatcctttagcatttaattccctgaaaagtcatattcttctggtacattccacgttgcccaactgtggatttgcatagtcagaaaaaagaaaaaatactatatcccagatgaggcttgggagcgtgtttaggatgcggatgagcatcttaaacacagcgactacagagcagatgggatatagtatttttttcttttttcgtctattaccaaatctacaaatcagaagttgtcacagtcttctcccgccggaatattataataaaaaacgcaggtgtatcattatgccagatgtaggaaccttacaggtatctcttgtttccaaccgggggaaacgtccgattacggatgctgcagtggaaatttcttctgcaggggaaccggataaaatattagaagtattaaaaacagatttgtcgggacagacagaagtgattgagttagagacccctcctttagaatattcaatggaaccaggactgaatcagccatactcagagtataatttaaaagtgacagctccgggctttgagccggtagaggtttcagggagtcagatgctttccgggcagcttgctttgcagaatctctctttggaaccgacaattacagaaacggcttcgtatgaagttcttgcaatcggtccgcacacattatatggagattatccaccaaaaatcgcagagagtgaagttaaggatgtgcaggcaacaggcgaggttgtattgagcagagtggtaatcccggagtatgttatagtacatgatggagcggtttctgataatacggcaaagaactattatgtactatataaagattatattaaaaatgtagcttcctgtgaaatttattctacatggccaaaagaaacattgaaagcaaatatattggcgattatgtcatttacgttaaacagagtatatacggagtggtacagaggcaaaggcaaagattttactatcacatcctccactgcatttgatcagaagtggatcaatggaaagaatacgtatcattcgattagtaatgtagtagacgagatttttaattcttatctgtcaagaccagaagtgacacagccaatccttacccagtattgcgatggaaagaaagtaagctgtcctgagtttatgagccagtggggttctaaagcgttaggggatgatggactttcggcgattgagattttacggtattattatggggaagatatgtatattaatgaggcagagactatttcgggggttccggcttcctatccgggatatgagttgacgaatggaacctcaggaccaaaagtgcggcagatacaggaacagcttaatgtgattgcaggagattatccgttgattcctaaaataaaggtggatgggatttatggaccagcgacggcaaattccgtaaaggttttccagaagatttttcatttgccgcaaacgggtgttgtagactttgcaacgtggtataagatcagccagatttatgttgcagtgagccgaattgcggagctgacataatttcttgcaaccagaaaaattgttatcggaattatgcacaaagtgatataggagaaaggggggaaagaagcggcgaaagatagaaattatagtttttcgcccttctctcttgtaattgtagtcgatgtatgctagaatttgtacaatttaagtatttatgcaaagagcggcaacgtgagagtcagttttcttcgcaagtctgaaaagacacgttcccggccgatttgtttgatcagtgtattttcgcacaacggagccgggggaacccgtctttttttttgcaaagagttacaaaaagagttacaatttagtagtaacttactctcttgcttttttgcattttccttaatatgcagttgcaaatgattgaatatagaaaggaacgtgaatcatgaaggcatttctaatcttagaagatgggactgtgctgaccggcgaaagctttggagcagcaaaagaagtaatcagtgaggttgtttttaacacttctatgacaggatatctggaaatattaacagatccatcttatgcaggacagtctgttgttatgacctacccgttaattggtaactatggaatttgtatggaagatatggagtctgtacatccatggccaaaggcacttattgtgcgagagtgtgcaaaactggcaagtaacttccgtaatgagatgacattggatgaattcttaaagaaatacgatgttcctggtatttcaggaattgataccagacatctgacacgtattttaagagagtacggtgtaatgaacggaatgattactacaagagaagatttcgatctggacgaagtagtaaagcagttgaaagaatacagagtaagtggagttgtacgtgaagtaagctgcaaggaaaagagagtgcttccgggagatggctttaaagttgccctcatggattttggagcaaagaagaatattgagaagtctttaaacaagcgtggctgtgaggttacagtatatccggcatatacaaaggctgaagagattatcgcagcaaaaccggacggaatcatgctttctaatggtcctggagatccaaaggaatgtgtggagattattgaggaactgaagaagttatttgctacgaatattcctatttttggtatctgtctcggacatcagctgatggctcttgcgaacggagcagatacaaagaagatgaagtacggacatcgtggagcaaaccatccagtaaaagatttaaaaacaggaaaggtttacatttcttcgcagaatcatggatatatggtaatggaagattctctgaacagagatatcgcagaagtaagcttcattaatgtaaatgatggtacattagaaggagttcattatcttggaaagaatgttatgacagtacagttccatccggaagcctgccctggaccaaacgattccgagtttttatttgaagagtttattaatatgatggaggttgcaaaagatgcctaagaataccagtattaaaaaagtccttgtaattggttccggtcctattgttatcggacaggctgcagagtttgactatgcgggaacacaggcatgccgttccctgaaagaagagggaattcacgttgttcttgttaactccaaccctgcaacaatcatgacagataaagatatcgcagatgaagtatatattgagccgttaacaccagaagttatcaagaagctcattttaaaagtttctccggacagtcttcttccaacattaggtggacaggcagcgttaaatatcgctatggagttagacgagtgtggtttcttaaaagaacataaagtaaagctgatcggtacaacaggtaaaacgatccgtaaggcagaggatagagaagaatttaaagaaacaatggaaaagatcggtgaaccgatcgcaccaagccagattgttacgaatgtagaagatggtctggaatatgcgcagaagattggatatccggttgttcttcgtcctgcatacactcttggaggaagcggtggtggaatcgcagataatgaagaagagtttgtggaaatcattcagaatggtcttcgtcttagtcgtgtaggacaggtattagtagagaaatctatcgctggctggaaggaaatcgaatacgaagtaatgcgtgatggtaacggaacatgtattacggtatgtaatatggagaaccttgacccggttggtgttcataccggagacagtatcgttgttgcaccttctcagacattaggagataaagagtaccagatgctccgtaattctgcattaaatatcattgatgaacttggtgtagaaggtggatgtaacgtacagtttgcattaaatccagatacatttgattattgtgtaattgaggttaaccctcgtgtaagccgttcttctgcattagcttctaaggcaacaggatatccgattgccaaagttactgcgaagatcgcacttggttaccacttagatgagattaagaatgctgtaacaggtaagacatttgcaagttttgagccggcgcttgactactgtgtagtaaaggttccaagacttccatttgataagtttatttctgcctcccgtcatctgacaacacagatgaaggcaactggtgaggtaatgagtatctgtactaactttgaaggtggtcttatgaaggccctccgttccttagagcagcatgtagacagcctgatgcatggcgattttgacaagttaagtgataaagaattagaagaacatcttcatattgtagatgatcttcgtatttactgtatcgcagaggcacttcgtcgtaaagtagaccctcagaagattcatgatatcacaaagattgatctgtggttcattgataaattaaataacatcgttgagatggaagcgaaacttaaaaatgcggaagaattagatcgtgatcttttactgaaggcaaaagagatggagttcccggataaagtgatcggagagcttatcggtcagaatgaggagtatgtaaagaacttaagacgtcagatggatatcgttccggcatacaaggttgttgatacctgtgcggcagagtttgcagcagaaactccatactactattcttgttttggaagcttcaatgaagtagaagaaacttctgataagaagaagattatggtacttggttccggtccgatccgtattggacagggtattgagtttgattactgttctgtacacagtgtatgggcatttaaagagatgggctatgaaacgatcatcgtaaataataaccctgaaacagtaagtacagactttgatatcgcagataagctttattttgagcctttaacagaggaagatgtagagcatatcgtagaattagagaagccggatggagcggtagtacagttcggtggacagacagcgatcaagttaacagagaagttaaataagattggtgtaccgattcttggtacaagtgctgagaacgtagatgcagctgaagatagagagcttttcgatgagattcttgagaaatgctgtattccacgtccaaagggaggcacagtatttacaaaagaagaagctattaagacagcgaatgagattggataccctgtactgattcgtccatcttatgtacttggtggacagggtatgcagattgcgatttctgatgaagatatttccgaatttatggatgttattcagagatatgcacaggaacatccaattcttatcgataaatacctgatgggtgttgaagtcgaggttgatgcggtatgtgatggagaagagattgttattccaggtatcatgcagcatgtagagagagccggaatccattccggagacagtatttccgtatatcctgcaagagacctttctcctaagattaaaaaggtgatcggccattatacaaagttactggcaaaggctttacacgtaatcggtcttatcaacatccagtttatcgtatatcaggatgaagtatatgtaattgaagtaaatcctcgttcttcaagaacggttccttatatcagtaaggtaacaggtattcctattgttgaccttgcaacaaaggttatgacaggaatgaagttaaaagagttaggttatgagcctggacttcagccagaatctccatactgggcaatcaagatgccagtattctcttttgagaagattcgtggggcagatatcagccttggaccagaaatgaagtccacaggagaatgtcttggtatttctaagaactatgaagaagcattatttaaagcattcttaggttctggtgttgatttaccaaaacacaagaagatgatcatgactgtaaaggattctgataagttagatgcagtagaagttggtaagagatttgcagcacttggctacgaaatctatgcgacaagaaatacatgcaagacattacaggaaagcggtgtgccagcgaagagagtaaataaaatcgaagagacacatccaaacctgctggatctaatcttaggacatcagattgatcttatcatcgatacaccttcacagggtattgagagaagcaaagatggttttgttatccgtcgtcatgcagtagaaacaggtgtgaactgtctgacttctcttgatacagcaaacgccttacttaccagcttagagtcttcctgcagagaagatttatctttagtggatatcgcagaaattgataaagagattgagagcaagattaacgaggcataaaaaggggagtgaatccctgatataaataatatgtactcatggagtcttttgtgcatttatccttgcaaaagatttcgtgggtatatagcataattgggaggataccgatgggaaattatacaaagcaggatattattcagcttgtggaagaaaaagacgtacagtttataagacttcagtttacggatgtatcgggaaatttaaaaaatgtagcgattacagccagccagcttgaaagagcattagataataaatgtatgtttgacggctctgcaatcgaaggtttcgtccgtattgaggaatctgatatgtatctgtatccggatcttaacacatttgagattcttccatggcgtccgcagcatggaaaggttgcccgctttatgtgtgatgtgtatcgtccggatggggtaccttttgagggagatagccggtatgtcctgaaaaatgtattaaaaagagcggcaaagatgggatatacttttgatgtcggaccggagtgtgaattcttcctttttcataccgatgacaatggacagccaacaaacattacacatgaaaaggcaagttattttgacgtaactccgttagatttgggtgagaatgcaagaagagatatcgttcttacattagagagtatgggttttgaaattgaagcatcccatcatgaagttgctccggcacagcacgaaattgatttcaaatatgataatgctctgataactgctgacaatatcatgacatttaaaatggtagtaaagacaattgcaaagagacatggattatatgcaacatttatgccaaagccgattaccgatattgatggttctggaatgcatatcaatatgtcgcttgaaaaggatggaaagaaccttttctttgataagaaagatccactgggactaagcaaagactgttatcattttattgcagggcttattaagcatgccagaggaatgtcctgtatttgtaatccccttgtaaactcctacaagagactcgttcccggttacgaagcgccggtagcaatttgctggtcttctattaacagaagtccgctgattcgtataccggcttcaagaggagccggcacaagaattgaattcagaagtccagatcccgcagcaaatccatatcttgtcatggcactttgtcttgcagcaggactggatggaatcgagaatcagttagaagcgccagaaccgattggtaaaaatatgtatttactgacagaagagcaaatcgcagatatgaatattgatgttttgccagctacgcttggcgaagcatgtgacgcttttgaacaggatacgtatattcaggaggtccttggagagcatataagtaaaaaatatctggaagcaaagagaaaagaatggcatgaatattgtagacatgtttctgactgggaaacggaatcatatctttataaatactaaactacagtcttttaatataccgactgtagatggaaacgactggatggcttatgaggatgagtgagaattgttgaatatcgttgttgtatttccgaaaaaggaaattgtattaaaaatgaaaaacgtcctgataaagaatggatatgatgtatcggccgtctgtgttaccggggcccaggctattcaggcagtggaaagactagaggcgggtgttgttgtatgcggcatccgctttgctgatatgatttattacgaattaaaagattgtcttccggatacttttgaaatggtagtcatcgcaagtaatgcacagtggcagcaatatggagatgatgatgttatttatctgccattaccgttaaaagcctatgatctggtcgatacagtgtctgatctgctgacagatatacatagaaagttaaagcaggaaaaagaaaagccggataagcgttctgcagatgaacagggagttattaatcaggctaagtccttactaatagaaaaaaacggaatgacagaggaagaagcacatcgttatcttcagaaaagaagtatggataatggaacaaatatggtagaaacatcgtatatggttttacaggtttttgatttgaaatgatttttatatttcgcgggtcccaaagtcaaaaactttatggtgtaaggacgaacggagttttgagctgttaatcctgaaacatcatttaatttaataaataaaacagatatcgtagatataattttgcaaagtaattctgaagaatcacagaaattttattaaaaatagcgagaacccttgttaattaagaaagagtatcgtatattttaaatgttgtatcagatgtgaaatgcgacagaagggagaagcctatgaagtttacaaagatgcacggaataggaaatgactacgtttatgtgaattgttttgaggagtctgtaaagaatccggcagaagtatccaagtttgtaagtgatcgtcatttcggaatcggttcagatggattaattcttattagtccgtcagcaatagcggattttcgtatgaatatttacaatgccgatggttctcaggcagaaatgtgtggaaacggtattcgctgcgtagcaaaatatgtgtatgattatggtctgacagataagacagagatttcagtagaaacattagcaggaatcaaatatcttcggttgcaggtagagaatggaaaggtcgcaagtgttgaggtaaatatgggtgcgcctattcttgaaccaaaagaaattccggttacagtagaagaaagtcctgttgtcaacgtacctgttgaggtaaaaggaaaaatctatcatatgacctgtgtatctatgggaaacccgcatgccattatttttatgaacaatgtaaaagatttggatattgcagcaattggtccatattttgaaaatcatacggtatttcctaaaagaacaaatacagaatttgtagaagtacttgatcgaaatactgtgaatatgagagtatgggagagaggtagtgatgaaacacttgcctgtggaaccggtgcctgtgcaacaacagtggcctgcatattaaatgataagacagaaaatgaagttacagtacatttgctcggaggagatttgaaaatccgctgggatcgagaagccaaccaggtttatatgactggcccggcaaccgttgtatttgacggagagattacccttccggatggtattgcataatatttttgagcaatgaattgtaagagacgtaaagaggcaaaagccagattggagtaactatgtttaaagtaaatgagaactatttaaaactgccgggaagttatcttttttctacaattggaaagaaagtagctgcatacaaagaggcaaatccagataaatctatcatcagtttaggtattggtgatgtaacacagccattagcaccaaagattatcgaaagtcttcatagtgcggtagacgagatgggaaaggcagaaacttttcatggatacgctccagatttaggatatgaatttttaagaaatgcaattgcagagagtgactataagagccatggctgcgatattcatgcagatgagatttttgtcagcgatggagcaaaatgtgactcgggaaatattcaggaaatattcagtatagataacaaaattgcagtatgcgacccagtatatccggtttatgttgatacgaatgttatggcaggaagaacaggaacatacgacccttccacagaaacctggagtgatgtcatctatatgccatgcaccgcagagaatgattttgtaccagactttccaaaagaagagccggacattatctatctttgcttcccaaataatcctaccggaacaacgattacaaaagcgcagcttcaggactgggttgattatgctaataaaataggcgcagtaattatttatgatgctgcttatgaagcatatatcagcgaagatgatgtcgcacacagtatttatgaatgtgaaggagcaagaacctgtgcgatcgaacttcgaagcttttcaaagaatgcaggatttacaggaacaagacttggctttactgtagttcctaaagacttaaaagccggagatgttactttacattccttatgggcaagaagacatggaacaaagtacaacggtgctccatacatcattcagagagcaggagaagcctgctacagtgcagaaggaaaagcacagttaaaagagcaggttgctttctatatgaataatgcgaaaattatcaaagaaggcttaaaagatgcaggatacaccgtatttggtggagtaaacgcaccatatatctggttacagactccagataaaatgccatcctgggacttctttgacttcctgttaaagaatgcaaacgtagtaggaacaccaggctcaggatttggaccaagcggagaaggatatttccgactcacagcattcggttcccatgaaaatacattaaaagccatcgaaagaatcaaagcactttaatttgtagatttcgtatagacgaaaaaagaaaaaataccatatcccatctgctctgtagtcgctgtgtttaaaatgcttgttcgcatcttaaacacgctccgaagccgcatctgggatatggtattttttcttttttctgactatcctaaatctacagttgatgagaatgggaattctccagaaggctttgactttcactgctattttcttatggtgaaatagttctcaaattaaactcttctctttctaacagaaatcattaatttgtagattttgtgtagacgaaaaaggaaaaataccatatcccatctgctctgtagtcgctgtgtttaaaatgcttgttcgcatcttaaacacgctccgaagccgcatctgggatatggtattttttcttttttctgactatcctaaatctgcagttggtgagaatggggattttccagaaggctttgactttcactgctattttctcatggagaatttttttctggttaactctcataatcttctgggcaatccccttatccacatccaaaatttaaatactaatttccatctggagtcaaagcacagaaaagcagaaatttaatccatcaaattagtatttaaaccgtaatgcttcttcgctggtctgggagaggattttcatcgcttcttctggataagcacccatagcagtttctcctgtcagcattaatgaggaagctccgtctaaaacggcctgaaagatgtccgttacttcagctctggttggtacagggttttcttccatggaggcgagcatctgtgtgacgaccataaaaggtttttttgcatggaggcacgttgtggagatccttttttgcacagcaggaagttttggcagtggaatagcatttccaagatcgcctcgt

SEQ ID NO: 447 - DNA, 20237 bp, Eubacterium hallii
tctttcctactaacagattggaaccttcacccttcttagtgatttctgtcattggaataccaagctctcttgaaagaatttccattgttctaggagtacagaaacctgcctggcaacgacccataccctgacgggtacgacgttttaatgcatccatagattttgcaccaagcggacgatgaatagcatctatcaattctccttctgtaaccatctcacaacgacatacaatatttccatattccggtttttctttgatcaaatcatttttctcttctatagaaagatcactcatatgtgtaataccttttctctttgcgatgaagttatctttttctggaaaatgatacttttcttcaattaactgtgatattctttccccaatagcaggggaacttgtaagtcctggtgattcgattccagctgcatcaaaaaatcccggtgcatccgcaacttcctctataataaattcatgattttcttcatgggcacgtaatcctgcaaaagatgtaattgttttattcataggtaaaatatcttttgtaagatgactgtgctgcgctttataaataagatcatctataatttcctgtgttgtatttactccttctttatcatccacgtctgtagcagatggtccaacatacatatttccatgaatagtaggggcacagagaataccttttcccatcttgcctggaagaggaaatacagatgcatgaaaataacttcccatttctttatcaagaagaatatactctcctttacgagcaataatttttatcttcttttcgctaaccagattatggataacatctgcatatacacctgcagcattaacaataatttttgtattaaaaatccccttattggttactacttcgtaatatccttccttctttataatattatctactgtatgttcaaacttgaattcacatccatttaccgatgcgttttcccccatagctattgcaagattaaaagggtcaataacacctcctgtcggagcgtacaatgccgctactgcattgggcgttaaattcggttccatttttaaaagttcttctttttcaacaatacgacaatccactgctccatttttatttgcctgttctaaaagaatatccagctttcctctttctgcttctacagtacacacaaccagggaaccattctgcttaacaggaaaatccagttctggtgcaagtttatataataattcgtttcctcgtacattcatttttgccattaacgttcctggtttcgcatcaaatcctgcatgaataacaccactatttgctttggaagtacctgaagcaacatcatcacccttttcaatgacgcacatatttacctgatacttagaaagttctctggcaatacaagtaccggtaacacctgccccaattacaataatatcatacatttttctacctccgtttttcaaattcaactttaattcaaataaaaataccctaaatcatctatattatacgatttgtataacaaaagttttatcttacaacgaacagatgatttagggtaatttttaattcagcttagaaatctctatatttatcctgaaattctgcaatatttttatttgcatgctgatgaagatcctgaaagatacttttccatactctatatgcatcttcgtaaagttctctgtttttctcgtttggtgtgtatctttttactacttttaccatttcttccactgcatctttatagctattgtaaattcccgctcctacagcagctactaaagcacaaccaagtgctgttgcttcgcttacttccacagtttctacatcccatccataaatatcggcctgcatctgattccatatctcagatactgcaatacctcctgtaatacgcactgtattaaatgtcggtacatttgcatcaagcattgcaagaagcatgtctttaagatcaaatgtaattccttccattgttgcacgaaccatgtcttctctagatgtagctaaagtcattccaatataagtaccacgagcatttaaatcataatttggtgtattagctccctgcatataaggaagataaaatactccatttgatccaggttttgaatgtgctcctgaatcagttaaaatatcataaacattcttacgtgtatgcattgctgcaaaagattcactgtgtgcaataatatctttaaaccacttaaatgcactcgctgctgcattagactggccttccattacatatgcaccgtccggagtaccaagtacataacattttctatctggatctctgagcatcttgtttgatttacccgctgtaattcctgctgtgccgccacaggcataaccaatgccttcttctatacatccaacaccaaggcaggcactctgctggtctccgattcccatgataagtggagttccttctgctaatcctgttctggcagctacttctttcgtaacatgtccaattactgttcctgtttcagctaacggtgccaatttttctctatcaattccaaaagcatctattaacttctgattatattgaaaatcttccccatttaactgaagccatggagaacatcctatgtcatcgtaataatcatctgcaccatatgctttattcattaatcccatcatcgtatgtattcttgtacaattttcataggcttctggaatatttttctttacccataacaattttgataaaggataggttcccgctaacggcataccacaaatatcataaaattcctctgcactaatccctgctttatttagcatctcttccatttccggaaccatttcaactcctcgaagatcctgccagataataataggagtagtaaatccacctttttcatcacgagtaattgcagtacatcgaaacatacaacaacttaacgctgcaatttcttctggattaatccccgaactctgaatagccgttcttgtagtttcatagagagtttcaatcatggcaggtccatcacattctacacgtcccggacttggataaaccagaggatttaatttttgtccaacaccaatctgtttccctttgaaatcaaaaattacggtcttactacttgtcgtaccacaatccacaccaacaacatattttttctccatcacgtacctcctctttaaatactttcttttttttacaaaacatttataaaacattcatctgtatttaactttgtaaaaaatcaagtcactcctttcttaatttaaaaatacccccgttttaatatcacttttcatgcttctattatatttctttggctacaaaaatcccatatcgaaagttttttcaataataatgtgccaatttttcattcttttttcagttattttatttaattttctgaaaaatttatatcaaaaaaagaaatgctgcaatcacatttcatccatttgtaaccgcagcacttctcttaaatatggtataaaaaaattgtatgacattttttagatacttttattatttataattttatatctagtttatattatcctttaagatcaaagattccacccttgttttcttcataaattccccaaagcttgagagctactccgagttcctcgtatttttctcctgcttcttttaatgtcattcctgccataacagcatcaatgccctgacgaaatgctcgtgctccagctgctggacccattggatgtccatgaatagctccacctgctgctatcataacatcatttccaaacttatgcataatatcttcgatatgtccctgtgttgttccaccacctggcatagggaatactggtttgatatggccaaatggctgaagcatcttcattcctgcactaataaatgtatccatcatcatcgggaacttaccatatggagataaagcaatcaccatatccagtcctgccattctaggaagagttgctccaataagatttgcacttaaaccagaccatggagactcatatactgcacctgtataatcggaatgagccaaaataggaacattaatatcaggatcttccgctaacattcttgatgcatcaaggccaattgtattgtagttaactaaaagacaattaccaccattttcaataacagccatggcattcttctttaagttttctgttctgtctgtaatgttaaatgcatataatgtcttttcgcctttttcttcgtcggctttcttaagagcaggcattacagcttttaccctgtcaatcaatggacaatgcggaggattacttactaactcatcatctttaatgatatctactccaccacgtgcagcttcataagcaagttctgcagttttctgaggatctaaccctgtacatggcttaatcatattatttaataaaggtctgtcataaactcctaataaatcacgaattccttgtacaccaaatttaggtcctttaaattctttcaaatagctgtctgggaattccaaatcaagtaattttacctcgcctgaacttgaaatattacctataacggaacttaacatcattgcaaaagatggtccaaaattcgttgcaggaaaagcaattctaatgataaaatgtcttttatcaatatcggatggaatacctatctgataagaaggagtttcataaacaccaactactcgtccgatacttctttcccgtacctcctgagtttcgccaggaaccttaagccaggttccacaagtctgctcaattgctaaagcaactgcaaattttaaactatttgtagttgcttttgttgcacaataatatgtggcaataacaaaacgatctttttctaaagcttctggatactgaactgtaataggatctataaacatatcttctctcctcccatatactttgttttgatttcgttgtttcaatctctatgattaaattataacagctttctcaaaattgaaaatatagaaagttttttcaatatgtattatttctattatagaatttcatctactgttcacattatatatttctatcttcaaattccaacaacttctgtgccagatagtaatctataattaaaacatctacaagattccctttcaatgctgaacgaatagacaatgccttctgttctccagatgccactataattttctgaggaatttgcttatactcttctaaacttatagatgccgtcctgtcttttaaagaagtcttacattcttctccatcttgatcaataaaccgtagcataagatcactgcatactctcttttctttcaataatttcttatcatctacatgcaaataatctgttttcaccaataaagaatccatttccggataaagagaaccaataccacttacagaaatatctaccttcttaaataactctaagaagcctctctgttccaaatatttttgttgctgtgcatatttctcttctgaacacaaacctggaattgtaatcgtttcacatcttcccccaaatgccatagaagttcttttaaccaaagactcaacttccagattcttattacaacctgctatgctcccatgtaatgtgataatattcgcatcaaccttccgacagggattcagatattgaatcagataatacatcgtaccaccccatgccattccaagaacatcattatcctttataatacgctgtacatagcgcgccccctctaaagcaacctgctttttaatcttaagagaatcccttctaagttctgaaggaattggtacaactatcaccgttttcaagccatatttttcccgaatctctttctccataatgttacaacttaaaaatggttccgttactttaatctcaataatgccttcttctttcgctctttttaacacgcgagaaagagtagatggagacaatcctaaactttctgctatttctgaacgttttttcccttcaatgtaatattggtaagctgctgtacttacaatgcatgtcgattgactatatacctcacttttcatcttatttcctcacatatcgtatttattttcatatgtcttctcgccctcttgtttgcctgtttcacgattaaaaatccagatattctagaattttctttataaactagctttgattttgcaaaattaaaaaattctgtactgatactataacatatttcttataatataccatatctgttttacaatttacttattataataattacaacaaaaaaatataaaaatcatattttttcagacagacaaaatataaaaattgttgtataattaatacggcttatgacaggcaatgaatgtatcgaaacatttgttcctaataataagcattctacatattctttttgcatccgtatgtgcactacataatatttaaatttaaccaggagatgattttatgcacatctgtttgcttcttataaatcagattatccagctttttattatgattcttatgggttttatcattgtaaaagcgaatcttctaaaagcagaggatagtaaaatattatctgttattgttctttatcttattatcccttgcgtgatcatcaatcatacttgcatctgccagagaatccggtgcaagccggttaagtattccaaaatgctgtaaaagcaaaaatactgctaaaatcacaaccagttctttcactgcccgcaatacaatgtctttctgagtgcttgctttcttcatgttcgaaagtaaaatctgcaaaaataaaatcaaaactcttttaagcagaaaaaaactgttacaatagactttttctatcataacagttttaacctacttttttgatgggtttatcatataaaaaaccttttttgctgtcaatatttttactacagttcacagaaacttcatttgttacttcaacattatttttctccatcacaaagtttctttctgttattatcgttacttaactctaacagtcattttactaaaggttccgctctgtgaatatatatatattacgcaagttccctttttctttgctttcactttgccagaactacttacagtagcaatagatgaattcgatgattcaaaacaaatacctcggtgtctctttactttcagcttcttcgtttcaggtagctgctctgcctctatcttaaagatctttccacttttcagtttaactttcttcttattaagtttcactttcttatagttaccaaccttacctcctatcgttgctacatgaatagtcttcgaagatgcaattactttctgtccttctgtcgttgttttataagcgacagctgtatacttgtagtaagtacctttattcaactttgtaaccttagcagatgttctggttgtactcacaacttttttaagcgaatatatttttctagcagaattacatctattaccatagataatataaccagaagctcctttaaccttcgtccatgataaattgatataatttcttcctgtcttcttagctcttaactgaagaatcttaaatgttgaacccgcaatatctccatcatttctgtttgctgtaattttcttttctatatcatttacagaaatcgaatcgttaacatctcctttgacatcctttttaggaatcactttctgggcaacaataatttgtccacatacagaacagtgggagccttccgaaagacctgtagttgttgtggttgctggaacagcagaatcttttactactttatgacctgttgccttaactactgtatcttctttgttgatttcttttccaatgtcagcatcggcaaaaagtttcttacaactggaacatacatagtattccttatttccgtcttctgtacatgttgctttccttgcttctaccttcatcaacttatgcacatgagctaaaacagggattacttctgtctctacgtgtgtcttatcattctcacagactcttcttcggcttccttcctctgtctcacttgcttcttttgtcacttcccaagcagaccatttatggccagttgccttgattacttttactctattttcattgattgcattacaaacatcacaatgaatactttggctgccattctctgtacaagtaggttctttatcaattgtatatttcgactgccaattatgttgtacttccacctggactgtcgtttgcagagcatattcatcagcgctatctgcagcataaattgtaattgttgcatttcccgcttccttaccagtaagcttaccatctttggaaactgtacataccttttcgtcagaagatacataatggacggaatcaggtaatagaaccgctcgctttaggatacttacgatagaactatttcctttttccttaatcttgaccaattcttgttcaggatagaaattgtttacaatatctgttgtgtatttaatcgtattaatctgattcccatttttataagaagattgcatcgcttcttctgataccttagataaaaattcttgtgtccagtgtagctgaccgtttgattcgacagctccaatgcctattgcagtaaaatctgatgagagaataggatatttgtgttcatccgacatccaagcatctacaaccttctgaggagttttctgacctaatgcacaattttctgttgtaccgattgctgtaaatcccataggtgattgatgactaaaatacagagcaagttcagaagctctatacatggcattatcaagcaaatcaacatccatagtcaccggctcaagattattttcttttctaaccttattcaccaacttaagaacttcataggcataatcataattatagtaaaaagaggctttcgccttatgaattactttatatgtatttcctcccatatttgtcaatttgtcgttgagtaaagtcagctttgtactatccggaaatgctctactgcctatagcagataccgacttaggaattacagcttctttaataatagaccctgtaaaggctccttcattaattgttttcaaaccttctgtaaaaattacattttttaatttgggacaatgagaaaaggtatatattttaattgactcaatattggatggaaacgtaacttttgttaagtttgagcaatatgagaaagcataagaattaatatatgtcaatccactgccaaactcaatagtttcgattgctgttttgccaaaggcccatgttcccataaatgttacactgtcaggaatcttatcaatcttaaaagatgaacaaccagaaaatgcactgtttccaatagaccaaactttatcaccgaaaggatacgtttcaagagattttgcaccattaaaagccatctctcctagcatttctacattcttagctccagttacctgcccaagagcagtacactcataaaaagccgctttctgaatcgctgtaatattatcaggtatataaatctcttttaaagacgaacactcagcaaatacctgttcacttaattcactcagtttacttccaatattaaccttatcaatagaactacatccacgaaaagccgcatactccagttgttgaagatctgttgataaatgaataccagacaaattagaacaaatgtagaaagctcttctaccaatgctttttacgtgttcaagattaatactttcaagctgtttacagccataaaatgtatctgcttcaatacgtgtaatccctgcaggtaaggaaacttttttaaggttactaaccgaaaaagccgcttccccaatagatgtcaggccgttccccaattcaattttttccaaagatccattccgaaaaaaacacatttctccaatcgaacgaacactatctgctaatttaacagattggatacttgtacttttataaaaagatgattttcctaaacctgtaatcccatcttcaacgataacacttttgatctcattaatatgggaataccagggaatatcactagtataatcgtaatccggtgtatctccactaccacttatacgaatagtatatccagaatcagaacttccttctaacgtccatgtaatattcttccctaaagatccacttaatgaatcatcagcagcactgtccttagcaaatgtttttactgaaaacagaatacctaaacatatcagcacagttataagccaactgcacctgctaaatagttttttcataactttcctcctccgtctaattattttattataccatataaaatacgaatttgtagatttggtgtagacgaaaaaagaaataataccctatcccatctgctctgtagtcgctgtgtttaaaatgctcgttcgcatcttaaacacgctccgaagccgcatctgggatagggtattatttcttttttctggctatccaaatctacagttggtgagaatggggattgcccagaagactatagttttcattagaatgaacatctctagaagaagatactttcttacttgattgtataaaaattacatttaactactcctacctcatggagaatttttctctggttagctcacataatcttttggagaatccccttctcttttcaacagaaatcactaatttgctattaaaaacagacagccgctgaaataattttttatgctgaattgtaaggaaactatggtaaagaaaaaagaatggttataagtattgcattttgtgactttgcgctatggaattctgaccataggaacttgggactcgtttttcccaagttcctgtttttctgggcagaatggaatgcttagcgcaacggaacaaaatcaaacttataaccattcttttttctttagaagactccatacaattcagctcaatatcttctattaaagcggcgtctgtgtccccggcaaattcgtatttttccactttttcattatgtagaagtaatatggtagtaatggtactaatgctgcgatccaagctgctgggtcggccatgcagacgccggcgaagctggttcgtccggctacgagggttactatcacgcttctggctacaagttcgaagattcctccgagcatcgggattaagccgtatcccattccctgtaatgtatttctatacaggaaaatgcttccgaggaatgggtagaaccacagtacggtatggaagtatgtgactgctacgttgataacttctgtttctgaggggctgatgaagagataggtcatgtattttccgaagaaaaacatggcgatcatgtcgacgatgctccaaccccagatcatgtactgtgtacagcgtacaccttgttttacacgttccattttgccggctccgcggttttgtcctacgtatgtggcgatggttgctccaaatgcgacgaatactgtcataaatatattctgcagttttccggctgctgagaatcctgccatgcagttttctccgtaaatgttaatggctccctgtacgatgattgttccgattgcggtgatggagaactggagtgccattggtatgcccagtcctaagagttttccaaatgatttaagtgagattcggaaatcttcttttttcaggcgaagaatcggaaactttttgcagatgtaaataaagcataagaaggcggagactgcctgtgcgattactgtggcataggcgcatccttctacgcccattcctattactacgataaatacgatgtctaatattacattgatcgcggcggaaatcatgaggaagtacagtggggaacgggaatctcctaaggcacgtaaaaatgcggataatgcatcataggctactgtgacaagtaatcccatataaataattcccatatacccttttaccgccggcataatttcatcagaataattcatcatgcgaagaatcggttcatttgctatggagaatccgatggtcattacaagggcaaatgcgatggataaataaatggacatcgcaacataatgccgcatcctgtcatattgttttgcgccaaaactttgtgctaccatgatggcaaatccactagtaagaccgttaagccagcctattacaaaaaacattaatgctcctgtacttccgattgctgcaagggcctgtacacccagaaactgtcccgcaacaatagaatctactacattgtaaaactgctggaacaaatttcctaaacacataggaatcataaactgaataatcagcttcgccggacttccgacagtcatatcattaattgtcgtttttgacatattttacactccttttcattcagatgtgagatgcgcagaagaagtatgtcatgcattgcatgacgcgcatcttgcaaaaagaatgcctggacattcttgaataatttaagattatttgacttttggactctaatatcatattataactctttaggaaaataactacaatacttattggagaggagaattaccatgcatgtaggacgaaaaacacaaaagagagagaaatctgcgatgtctgtttctctttacggcaacttactttttgtcgtgatcgagcttgttatggcaatattgactggttcgcaggctgttttacttgatgcagtttatgacggggtcgaatttgtcatgcttctgccatcgctgtttctgattccttttctttatcgaccgtcaagtgaacaacatccttttggctacacacagattgaaacgttgtttattgtaatcaaaggtatcactatgactgccgttacatttggtctaatttttaataatatcaatctgatgatacatggcggacatattatttcttttaatacagttgcatactttgaattatttgcctgtgttctgggtattattgttactgtttatctttacataaaaaataaatccatgcactctcctcttatcaacatggaaatgcagggctggcgtatggacagtgtggtttctttaggcatggcatgtgcctttttactgccgatatgtattccgtttgcatggtttaaaaatctggttccttatcttgatcagattattacagttgtcctttctcttattatgattccgacaccgattcgtacggtgattaccggaattcgtgatcttatgctgattccgccggaagaggaaacaatcgaggatattaaatcgaccgtagaaccgattatcggtatctacggccataaaaatctttattatgatattgtaagaaccggaaggaagttatggatcagtgtctatatcacttttgataaagatattgtctccctgtctaagttcaaactcctgcaagatgaatgcattcttgctcttacaaaaaaatatcctgacttttactttgaattacttcccgatattgaatttaccggtcttgaggagaatttgaattctttttaatatgtatttccggaatcgctacgttctcatacgtgataaactcatcttttctctcttccggtgctttctcgctcctgccttctccgatatggagttccggcatggcgagattctcgctggatactttgtagtctgtatgatgtttttcgtgttttacttttttctttttaccaaacataaaaatcccccttttttgtaagatgtactctcggagtctttcttgcacttgcttttgtggctgattttccgccagtcgcacccgaatttcatcaacgtacgcctcaaaaatttgggcacaactgacaaaaaatcttctcacgaaatcaagcacaaaaagattccgagaatacattaagtccctgattttccttggatatgtgttataaaatatttataaaaaatgtaattgcgagactgtttaggaagtctgcaaataaacttccgaccagcggtactaataaaaatgcttttacagatggggcatacttttcacatactgcctgcatattggccattgcatttggcgttgctcccataccaaatccgcatactccggatgacaggactgcggcatcatagtctcttcccataacgttaaatacaacgatatatgtgtacagaaacataaggattgtctgtcctgcaagcaaggtaattaacggtaatgccaggtcggcaagctgccataacttcagtgttatcattgcgataccaaggaaaagagacaggctgattccgccaatatcattaatctcacccatataaatagtaaacttgccggaatactctccgatatttctcatgcatgctgctgcgatcatcgctccgatatagattggaaaagtcatccctgtaagtgataacagcttagaaataatcgttccaattccgatggcgataataagctggaatacagcggaaggatacatactggcatggcgttcatgcttcttctcgtcttctattaacaggctgtcatcttccgcaattactgtatctaacagattcttcttttcaatgaggcgtttcccgaccggtccgcccatcacacttccggcaattaaaccaaatgtcgctgccgctgtacataatgtactagctcccttcacaccaaagtcttcaagaaccggaccaaatgcgcctgcggttccatgccctccgatcatcggaatcgaacctgtacaaagccctactagcggacttatgtgcaaaagctttgcaagcccgatcgcaatgaaattctggcataagattaatgtgatcaccagtcccagaaaaacaattaatgactttccaccactttttagtacttttaaattcgcctgaaatcctaccgatgtaaagaaaaataccatacagacttcttttaaaatgtcatcaaaagaaaactctgcgattccggtcacataacaaaggcaggtaaagatggcaaatatcacaccaccgattaccggtgccggtatacaaaacctctctaaaaggcttactctttcttttaaaaactttcctaacatcagaacaacgaccgctacagcaattgtctgatacatatctaattgaatcttcataaaccattcccctaatctgctatatttataccacattcctcatagtatgctgccgcacctttatgaaacggaatggtaactccctctactgctgtcttctcatcaatagaaatatctaccggtaaagagtactgcaattcctctttatttttaaataaaatcttcgtgatatcctttactgtatctgcggaaagcttatcactagcaagaagcactgcctttacaccaactgtctgtatgtcctccgtctgcccttgataggtttcttttggaatcgtacagtttgtataaaacttataggttctctttaatttatctgcgctcttttcgtcaatgttcaaaagacggatatcgcacttctttgccagttctccgattgcggttgtctgtgctcctgccgtacagaaaaaggcatcgatcgtacctgcttttaattcctgcgccgcattcgtataatccagattcacctcatcaacaaggctgtcattcaaaccatagaccgcaagaatctgcttcgcattctgttccgtaccggactcttcttctcctacgctgactctcttatcctgcagatcctctatcgtattgattcctgaatctgcacgcacaacaacctgacatgcctcggtatacaatgctgctacggcactgtatccgccatgcttcttttcgttttcaaaaatacctgttctctcatatgcatcattagttaaatccatctgtgcgatcgccatctgaatatagccatcggaaagcagacgaagatttgccgcagaacctgctgtcgtctttacttccatgctatacttcttattctttgacgtcaccagattcgcaaatgtatcaccgaacacacgatatgttcctccaagaccagccgcgccaaacttgatttttcgtgtattcatgccacatcctgtcaaaagactcgcaagtataaggatgcacatacaaagagaaatccatctttttttcacaaaatcaccccttcattcctcatagtttctttcctcttttaatttttattatagaagatatgttttaataaaaaatatgttttatagaagatatattgctcttcccgatacatatctctaaatatgccaagttattctatcatattcttgcaaataattcattaatatttctatatttctattgacattttctcatatatcatttataattcaattatagtaataattactatttttatttacacgagttactacaagattttgaaatttagaagatatgtacttgcgaagtttttgcatttgattttgtaagaagagtttttcaagactgcgagagtacatgaatcagaaaaggagaagaagatatggctaagttttatcgttccgaagacagaacagttttatttgaattatttggtgcaggcacatctgtagagaatctgaagaacctgaaggcgaacacaacagatgccgctgttgaaaagcatgtacctgtagtaacacaggatgggaataaggttagtgttgcagtttcttctgtagaacacccaatgcttcctgaacattatattatgggcgtatacattgagacaaagaacggcggacagcttcatagattccagccgggagatacaccaaaggctacttttactttagcagatggtgatgaattcgtagcggcttacgaatactgcaaccttcatggattatggaagtccgaataatcatagcaatcctatatgaaccatagcagatagacaaagaatggtgtcacaggaatggtctaatgaccataactgccggcaccatttttttgtgttctgttcaagaatgcctccccactgatactgatttgttgctactacctacaaaggtgggagtcatctcacatgtgatataaagaatcgctgcttgactttagtacgatttcagactataataagtatgaaatcagactaagtgtttcatgaaaggagtattttatgcaaaattctacttctgttacgccatatatgagctctaatttacgggaatataatcgaatttataaagaagtgaatgatatttaccgggagattgccgccagatttgggctttctaacagtgcatttgatattttatatacgatctgtgaagttggcgatgggtgcctgcagcgtgatgtgtgcgatgctacttttattccaaagcagacggtacattcatccatccgtaaactagaacaggaaggctatcttactctttctagcggaaagggacggagtaaacacattcatttgacggaaagtgggcatattttattaaaggaaactattttccctattgttgaagcggagaatgaagcttttcttggattaagtcaggaagaatgtgaattattactgaagttacatggaaaatatgtcaccgctttacggaataagttttccaaactttaatgtacaggatttttatgtacaagatttttcaggattttttcagaatttttgacatgattttttgctatcattatttacgaaaggatttattttatgcaaattcaattatcagaacattttactttcagaaagcttctgcgttttgttctgccttctattatcatgatgatttttacttctatttacagtgtggtagacgggctttttgtatcaaacttcgtcggtaagactgcgcttgctgcaattaatctaactctccctatcataatgggactgtccgctctcggttttatgattggtacaggaggaagtgccattgttgcaagaatgcttggagaaaaaaaagaagataaggctaatgcgtatttttccatgctcgtttatgcaacgatgcttggaggaatcattctttccgttcttggtgcgattctgattccttctatttgttccttacttggcgcaaaaggagagcttttatctgactgtgttttatatgcgagactttcttttatctccatgcctgcatttatgctgcagaatgtttttcagagtttctttgtcactgccgaaaaaccgcatctcggtctttatgttatcattgccgccggcatgacaaatatgattcttgactttttatttgttggggtttggggatttggacttgcgggtgctgcgattgcaacggtatgtggcgaattgatcggagggctttttccggtaatttatttttccagaaagaattccagcttacttcatcttggtaaaacacactggaatggacgagtttttttgcagacttgtattaacggttcttctgaacttatgacaaacctttcaagttctatcgtaaactctctttacaatatacagcttatgaagtttgccggtgaaaatggcgttgccgcctatggaacaatgatgtatattaactttgttttcctggctatcttttttggttattctatcggaagcgcaccgattatcagttatcattatggttcaggaaaccacgatgaactgaagaatctgtttaagaaaagtcttacgcttgtcggaacctggggaatcatgcttgcactactctcacagctacttgccgctcctctctccaaactttttgttggatacgatgcagaactttttgccatgacagaacacggtttccgcatttattgtcttgcttacctgattaatggcttcaatatattcggttcctccttctttaccgcactgaacaacggtgttatatccgccgcaatttccttcctgcgtaccctggtcttccagattattatgatccttttacttccaacattattgggaatcaatggaatctggagcgctgtcggaattgcagaattaatgacattatgcgtaactatcaccttcttcatcaagcaaagaaaaaaatatcactatgtttagttttactatttgattcattaggggaaaacaaacaaaaaaagaaataataccatatcccatctgctctgtagtcgctgtatttaagatgcttgtccgcatcttaaacacgctccgaagccgcatctgggatatggtattatttcttttttctgtgttttggctccacgtgaatgaatgcaatagtctttggagagagatgggggaggggacagaaggttgtggcttatcctgatgtctttttcactatgctgaaccttttttcaagtttcactgatgataatatgatgtcgcaagctattactttacatgatgaatttatcattatattgtcgcaatatatcatttttcctcttctgacgagatacctttcgagcaagcagtagacttctgacttctcccccttctctcctcaaaaactattgcattcatttcttctggagccaacaagcagaaaataaaactattagcccatagccaatgtaatgtgagagcaagtaaaaatgccgaacaggcattttctacgcagtgatatctttacagtggctatgggctaatagttttattttcgtctgtttcctctaatgaatcaaatagtaaaatcttccattgttatattttttgcaatatagtataatggagagaaaactagaggagatttgttgtggtcaagcttttttataacactttgacctaattattgctacagggtttataccccgtagcaataattaggtcaaagtgttataaaaaagcttgaccacaacattgtacgtcttcatcttgaagagggacgaaccctcaaaggtcttgctgccgaatatggcgtatctaaggcaagtatatctatttgggtaaaacagtttcgtgaagaatgccaaacaaatgaagaagccaaagcagattatgattatatgaaggaaaatttgcagttgaaaagacaactggcagaactccaaaaggaaaatgacttcctaaaaaaagcagcggcattctttgcgaaggaaatcgattagcggcttatcgatttattcagcagtatgggcacaaatacggtgtccgttggttattgaaaagactgaacatcctaccaaatgcttattataattttctgaaaaacaggaaatctgaatatcataagcataagggaaaaatcaagcatgaaatcgtggacatctatcactctcacaacggcactgatggttacagaactgtgcacgcttatcttattcgcaagggatacagtatcagttgtgcaactgtccataagtacatgaatactgagcttcagttattttcaattacaaggaaacgcaagccagactatgaatatggcgctcctcacaaagtatttaaaaataagctccatcaggattttaaggcagaatccataaaccagaaatggtgcactgattttacctatttatttttaacggatggtagcaagcgttataactgtacaatcattgatctgcatgatagaagtgttattgccagcattaccgataagcacataacagcagatcttgcaaagaaaacactgcagaaggcaattgattcacagccgggattagatgctaacc

SEQ ID NO: 448 - DNA, 19375 bp, Eubacterium hallii
cttgatttgggatcaagaggccgcaggttcgaatcctgtcaccccgatatctgcgggtgtagttcaatggtagaacactagccttccaagctagatacgtgggttcgattcccatcacccgcttctgtgtctgtagctcagctggatagagcaacggccttctaagccgtgggtcgggggttcgaatccctccaggcacgtttatcagatggttctgatatggtgggtgtggcgcagttggttagcgcgccagattgtggctctggaggccgagggttcgaatccctctacccaccttgtagttccatttttataaatatttatatggcgggatagctcagttggctagagcacgcggttcatacccgcggtgtcgtaggttcaaatcctattcccgctacttacatgggatcttagctcagctgggagagcatctgccttacaagcagagggtcacaggttcaagtcctgtaggtcccatatatgccggcgtggcggaactggcagacgcacaggacttaaaatcctgcgggacttatactcccgtatcggttcgattccgatcgccggcatactttaaagaatttgtgggcatagctcagctggatagagcgtttggctacggaccaaaaggtcgggggttcgaatcctcttgcccacgtttaattacatatcataatatagcgctatcgccaaatggtaaggcactggattctgattccagcatttccaggttcgaatcctggtagcgctgttttagtaaaaagacacttcatgtgtctttttttgtttacaggaaagaaaactgcgttcttataaagaaaaaacactctgcgaaaatacgtatgctcattctttgattttatattgaaaaaagatttcgggaatacatggagtatttttttgtattaaaattgttgtttcaaaagcatatttcttgaaaaataaaaattttttttattttaacaaagtaccagttggaagtacggtaggtgcaggagacagtgttattgcagcactggcactttcagaagaaaaaggaatgagtttagaagaaaccgttcgtctttctacagcaacgggggcggcaaatgtaatgtgcagtggaacacaagctgcagagtatgaagtaatcagtgaattgatttcaaaagtagcaatgcatacaatgtaataaaaataaaaaatatattgcaaaatactatatttattcgttatcataggaaggagaattatttatgaaagcaaaaggtgtaagacttcatggagctaacgatcttcgtctggaggaatttgaacttccggaaattacagatgatgaaattcttgtaaaagttatttcagatagtatctgtatgtctacctataaatgtgctattcttggtacagagcataaacgtgttcatgaggatgtggcagagcatccggcaatcatgggacatgaatttgccggtgatatcataaaggtatgaatcctttataaaatctactgcaatgcattagtcagatcaggtaatcgttttataaaaaagtaaaatacagtaattgaaacagctataggaaaaaagatatgggaaaatagatatggaacaaacatggaaatgtagtggaaatgatttaagaaagatgcccttacagatctgggaggaagatctatctattctttcaaatgcagaggcaatgaaaagagtcttacttgcatggaaacagatagaaaacagaaaagaaattgttgtaccgcttgttcagaatatagagggagctgttcttggagccggtattataaagagaaaaaacttttggacaacaggagagtatccattttccagtttagaggaaataaaaccgaaacagcttacactaatgaaaaatcctcatataaaagccgttatagaggttataaaacagttaaaaaatgaaacagttattcttgaagcagaggcgccattttctatagtatcggcactcattaacccgatggagctatatgcatcgatgcagacaaaaacagaacatttaaatcgtatattagaaaaaatcgcatttgaggaagcaaagtatttagaagccgccatcaatgcaggttgccatataatttctttagcagaaccggtaggaacagcagatatggtcggggaaaagtattttagagaatgtagtgggagagcggcagttttacttttaaaagaaagtgagagatttctacaaaacagcgtagtgcatctttgtggtaagttatcaaactctatgcttgctttacagatggcaaaggaagaagaatacctcgtaaccggggaagaatatcttgagagtttaacagaagcggcacataatccctctatacattttgtgggacagcattgtattcatcaaaagaaaaatagtacaaaaaaaattcatattcttacaatttaattaatttaacaggggaacaacatctttcgggtgatgagtgacggctgctcgacttgaataaatcttgatgaaataaatgaaagagagagatcttataagcaggaagtaaatagtaaaaatcaggaaagccgttgggttgagttttttgcagaagaggaataaaatagcaaaagtaataaaaaagagatgcaatagatagtaaaggatgatgaaagatatgaaatgtagtatgtcaaagctttttagaagcttttttatttttgtgttaatcttgattattgttttccctgccacaggatttgccgcaaagacgaaaaaaagctcttctgcagatttaaaaagtaataagaatgttcaaaatacagatatgacggaaaaatataagaaaccgatgaataatatattagaagcaacacagcttttttacagtgttcgtttaaattacagcatgaagagcggagaatcaaaaaagataaagcttacttctctcgaaaagcagaatattgcagcaggaagacagattttagaaggacagagccgtattacaaattttgcattttcacagagagtgcaggaactttttggtgcgaatgcgagaattgcttcgttgccttttaagacagagccggatgtcccgaaagaattagtggtgcgttgtaattcaaattatgtaaaactggcagtaggagaatggggagaagagtcaccagtatataagttaaagtctgtgacaaagaaagggaagaagtggaaggttgtctttaaagttaatatgtacgactcttatacagatagcatgcagccacttggcaaagtaattctcacattgaaaaagaataaaaaatctgtgtatggatttaacattaaaggaattatattaaagaaaatgtaacttttttctgttttttgtgctataataacattgttaaagtataatcaatgcaccgtaatagggggagacggaatatgggattatttagttttgagagcaaacaggtcaaagaatggaagaagcttgcaaagtccggtgatatggatgcacagtatcatttggcgagagcctatgcgaacggaaaaggtgccagtcagaatatgaaaaaggcagtagagtattgtgtgaagtcagcggagcaggaatatgctccggcccaggccttacttgctcatttttatggctatgggaaaggtgtggagaaagattatggtgaaatgattcactggggagaaaaggctgcattgcaaggctatgcaaaagcacagtataatatgggacgctgctatgagatgggtaaaggtacagaagcagatatggaaaaggcaagaagatggtatacattggcagcagaacagggcagaccggatgccgcttataaattaggacagttttatgagcatggtatcggagtagaggaagatatggaaaaagcggaagaatggtatcaaaaagccgctgaagaaaatgttgaggaagaaattgccataattgaagaagaaaagaaagataccgctactataaaacgggaggaaacatcctttacacaaacaggaaatgtaaagatatcagatgtagatcaccgcagaaagtatcgctgcctttccgaaatgaaagtaggagaagcaatcttcctaaaagaagacgaactgttagaaagtccattcatattaataaagtctgaaaatcatgaaacagaactaggatgggggaaagcaagagcaatctgtaatacggcagcactggtaagtcttattacagggaaaaacaaaacagcgatactttattgtaataatggaagcatgagtaaggaagctttaaaaagtatacaggcacaggtcgaggatgaatataaccatgaaacagtagcctggaatgagccacatccaagaattcctgttgtattaaaaaatgtacagtatacccataaacataatgagatatatataatgacagatataaaaacacaggaagaatatgaaatgattccacaaggctgggcagtaccgattcttgataaactagaatataataccattgtaacgattgcatattatgaaggaaagtgggtatttgtcagcaaaaaagaaacaaaagatatcggaaagtataaatttgatatcagataaaatagcctgcaaattaaaagaatatcttcgtttgccattctaagattttttcaactgatttgtggaatgggaatacatagaacgctccctctctgccctatataaaaatgctctccagagcaagttcaagctgtggatgaacagtttgtatataggacagagagggagcgttcgttttttctacaaatcaaaacgatgcttcagatatccagttctgaatagtttctatagaaagatttactgcttttgcaatctgttccgaggacattcccatttcaagaagggcaagagtagtttctcttgcttttttcaattcccctttttgtacgccagattgttcgccttcattataaatctcttctaattcctgacacatttgattcactccttcctctgtttcctttagttgatgtactctggttgcaagaatattactatacatttcatccgcttctttgcaatgtaagtcatgcattaagcggcctaattcggtattatcctgttttttcgagtttacatatagaatatgttgaccatcttcaaatatttctccggtttcgttgcttcgtcttcttatgtggttgattggcaggttatatccaaggacatcatttttagtaatgaaaatgacataagtttccgggagattgtcaaaaaaatcgcctggattcagtagattcatatccagtagaccgcagtggtatctggctctttttggagaagcaccatcattctcaccttgaatctccacattaaagtgattgttttctgcatcctttgccacgcagtctaaaatggcggaacgcccctggagatttttataatctttctgtaaagtctggtcgattacttttaggtctgttctattcatgataacctgaagaatatattcagtacatgcggtttcctttaaaacattccgcataaagatgtcattcattatcgtaaagtgttttatcttttctttatatctttcgtagcgttgttctaagccttctggctgtaagattgtggaatccgtcatttacgctacctccaattatgatatattaatgattattatatgactattatatacataatttgacataaaagtcaatgagtatttgaatcagaattttgaacagaaaaaccatgcccttctggagaattctcatttttaccaactgtggatttaaattagacagaaaaaagaaaaaatacgatatcccagatgctccgaagccgcatctgggatatcgtattttttcttttttcgtctacatcaaatctacagatcagaattcttttatcaaaagtgtcgtaaaatcaagaaccatcaatattcttgaaatcttcccttaattgtgttactctaatctttgactttatttgcaacaaagtattctcggaaggtttttgtaaaatgattttccgagagtactttcttaaaaaagaaaggagcttttatggactttaagaatgtgatagcgattgatgcgatgggtggagataatgcaccgggtgagattattaaaggtgcgattgatgcgattaatgagagagcggatatcaagcttcgcctttttggagataaggataagattgaagcagagcttcataagtatacttataataaggaacagattgagattacgcatacgatggaggagattagctgtaatgaagcgccggctatcgcaattaaaaagaagaaggattcttctttagttgtagcgattaagtctgtgaagaacggcgagtgtgatgcgattgtttctgcaggcagttcaggtgcgattcttgtcggaggacaggtactgatcggtaagggaaaaggtgtgaagagagcaccgcttgcaccgcttacaccaacagagaagggagtttctcttttgattgactgtggtgcgaatgtagatgcccgcccggaacatcttttacagtttgcccagatgggttctatttatatggaagatgttgttggtgtgaagaatcctcgtgttgccattgtaaatatcggtgcagaagaagcgaaggggaatgcgcttgtaaaggagacatacccactgttaaaggcttgtaagaatattaattttatcggaagtattgaggctagggatattccaaagggagaggcagatgttatcgtaacagaagcttttgtcggcaatgtaatcttaaagcttgaggaaggtcttgcaagtacattgatccagataattaaagagggaatgatgtctacaacgaggagcaagcttggaggtcttttagtaaagcctgcattaaaagagacattgaaaacatttgatgcgacagagtatggcggagcgccgcttcttggtttaaagggacttgttgtaaagattcatggaagtgcgaaggcaaaggagacaaagaaggcaatcttccagtgtgttacattcaaggaacagcggattaacgagaagatcgtagcgcatcttgcagaagaaatcgaacaggcaaaagaagaaaaggcaggcgaacaggaatgattaaggcagaacgatttaaaggattagaagagaagatagggtattcttttacgaataaacggcttttggcattggcgatgacacacagctcttatgcgaacgagcagagaggacgcagaaaggcgaataatgagcgcctggagtttttgggggatgctgttttagaagttacgatttccgattatgtattcagggaatatccatcttataatgaaggccgtcttacgaagcttcgttccagtcttgtttgtgagtatacattagcgatctgtgcaagagacgtagaacttggaaagtatatccttttaagcaggggagaggatgctacgggaggaagagaaagggattcgattctttcagatgcatttgaggcactgatcggtgcgatttatatagatggaggtatggataaggcgagattttttattcataatcacctgttaaaggatgtagaagataaatcgttattttacgatgcgaaaacgattttgcaggaaatggtacaggcgggaccggattctcgcttacagtatgtgcttacaagagaagcagggccagatcatgccaaggagtttactgttgagactagaattggtggcaagacatatgcaatcggaaaaggaaaaacgaaaaaaggagcagaacagattgccgcttatcagaccatactactgttaaaaaagcagcgggtgtagcatgtatttaaagagtattgaaattaatggatttaaatcctttgctaataagatcgtttttgaatttccacagggaattacaggcattgtaggtccaaacggaagcggtaagagtaatattggagatgctgtgcgctgggttttgggcgaacagagtgcaagacagcttcgtggagcgaagatggaagatgttattttctcaggaacgcagagccgtagaccgatggggtttgcttatgtagcgattacctttgagaatgcgaatcgaatcatccctcttgattatgaagaggttacggtagcaagaagggtatatcgttccggggagagtgaatacctgattaatggaagttcctgtcgaagaaaagatatcgtagagttattttatgataccggtatcggtaaagaaggttattccatcatcggacagggtcaggttgagaaaatcttaagtggtaagatcgaagatagtcgtgagttgtttgatgaagcagcaggtatcgcaaagtataagaagaatcgtacagttacggaaaagtcgctagagcaggaacgtcagaacttagagcgtgtcacagatattttagcagagcttgaaaagcaggttggtccgttagaacagcaaagtgcaaaagcaaaagaatatttaaagcttcgtgatgaagaaaaagatattgatacacacctctttttatatgattatgagcgcctgaaaaaggaacaggaagaaaatgagaggcagtatacgattgtttctggcgatttagaagagacaaagaagacttatgaaaagattaaagaaaagaatggaaagcttcaggaacagacacaggcagtaacagatagtcttgagacaaaagaatctgagaaagaggaacttcgtcgaaagaaagaagaaaaagataatgagattcttattctttctcataaagcagaatccaatacgcttctgattacgcattatgaggacttagagaaacaaagtctggaagaaaaagagaaaaagatcgaagaagtcggacagttaaagaaaacgatcacagaaaaaggacaagagatagaacaggggcagaaagccttagatgctcttgaggaatctatcgttgtaaaaagaaaagaacaggagtcttgtgagaaaagaatttccggggagaatgaccggctcttttccattatgaacagcagctctgatacaaaagagaaactcagtcggtatgcggcaatggaggaacagcttgagattcgtaacgcagagtataacagccgttacatttcttttaattcagagttaaaagaatataatgaaacagcagaaaaactacaaaaacagcagtctgaggcagaaagagcggttaaagaacaggaagaacggtaccaagagcttgaagagaaaggaacgtctcttcagaagaaggagcagaattatcaggatgagatgggaaacttaaatcaggagtaccttcgaacaaagtcccgttatgagacacttgtcaatatttcagaaagatacgatggatataatcagtcgattcgccgtattatggaacaaaagggtgtaaatccaggcataatcggtgtggttgctgatattcttgctcttccggaaaagtatgagacagcgattgagatcgctcttggaggcgctttacaaaatatcgttacggaagataacgaaacagccaaaaaaatgattcagttcttaaagaagaatcggtttggacgagcgacttttttaccgcttacgaatatccgccgaagaaacagtacgatttctccggctgttttagaggatgagggtgtcattggaattgccagcacgttagtacaggtagaagaacgatttcaggcattagtagaatctttacttggaagaacggttgttgtagataccatagatcatgcactggcattatcgagaaagaataatttcagtcttcgtctggtaacacttgacggggagttacttaatcccggcggtgcgatcacaggtggagctttccggcactccggtaatctgcttgggcgaaagcgtgagatcgaagaatgtaaagagacgttaagaaaggcaaaggctgcctgggaagaaagaaagagttctcttgcagatctaaaagaacgacagcggaaactagaggaagaaaagcaacggaaaaaggcaatgcttgatgaggcatctcttgttctccatgacctgaataatcagattccggatatggagaggaaaaaggaagagctgaaagaacgaattgcttcgttaaaggaagaacatcgggttttaaaagaacagattgatgatattcgttctcaaaaggaagcactcttaaaagagcaggaagataacgagcagattcatgaaaagaatcattcggttcttgattcactgaaagaaaagcttgcagagataaaaaaagaagtttctgatgtagaaacagaaaagaatgaacttcgtctttctctttcaaaaaaacgtcaggagcttgcgtatctgcaaaacgatcaggaacgtattgaaaaagaaacagaaagtctccagagttctttagaagaaaataaaaaagaaacgagccgtcttacagaagaaaatatttcttatgaaaaagaacaaaagttgttgcaaacagtgttgcaggagattactatacagatggaggatatttctggtaagcttgaagagttaaaacagcagcgttctactgctatgaaaaagcagaatcagattttccaggaactagaaagcgagaatgataagctgttgattcttgagaaagaagcttcaaagttatcttccagacaggagcgcatgaaagaagatttagaaagtaagatagactatatgtgggaaagttatgagcttacttacaatcaggcgcttacattaaagcattatgaattaaaagcagaggatgcagcggagcaccgcagacagaaaaaagaactgcaaaaacagatcaaaggccttggaaatatcaatatcaatgcgattgaagagtataaagaagttggcgagcgatatgaatttttaaagggacagtatgatgacatcaaagaagcggaagcaaagctgcttacgatgatcgatgaactgaatctggcaatgaaggaacagttcacaaaggaatttggaagtattcagcagatgtttactactgtatttcaggatctgttcgagggaggaacggcttctcttgaattgatggatacggaaaatattttagagtgtggtatccgcattattgcacagccaccgggaaagaaactgcaaaacattatgcttctttctggtggggagagggcattgacagcgattgccttactttttgcgattcagaatttaaaaccatcgccgttctgtcttcttgatgagattgaggcggctttggatgatgcgaatatcgttcgtttttccaaatatttaaagaagttatcgaaagatacgcagtttattgtgatcacacaccgaagaggaacaatgaacgcggcagatgccttatatggaatcactatgcaggaaaagggtatttctacgttaatctctgtagatttgatcgataaggatctgaattaattttcagtattttttgcaggttatgagaggagtaattatgggagaaaagaagggcttttttagccggttagtcagtgggctgacaaaaacaagaaagaatattgcatcaggtcttgattctatttttcatggattttctaaaatagatgatgatttctatgaagaattagaagaaattctgattatgggagaccttggagtagatacgacaatgaacattattgaagatttacaggcaagggtgaaggaggaacacattaaagaaccggcagagtgtcgtcagcttttaattgatattattaaaaaacagatggcagtagacgagacagcgtatgaatatgaaaaccgtacttccgttgttctcgtgatcggagtaaatggtgtaggaaagacaacaacaatcggtaagcttgccgcacagttaaagtcacagaataagaaagtaattatggcggcagcagatacttttcgtgcggcagcgattgagcagcttacggaatggtctaacagagctggggtagatattatcgcacagcaggaaggttccgatccggcagcggttatttacgatgcctgtcaggcagcaaagtcaagacatgccgatattctcttatgtgatacagcgggaagactgcataataagaagaatcttatgaacgagctttctaagattcggagagtcattgaaagagaatttccagaagcctatcttgagacattaattgttcttgacggaacaaccggtcagaatgctttagtacaggcgaaacagtttaaagaagtatcggatatttccggtattgttcttacaaagcttgatggaaccgcaaagggtggtattgctattgcaattcagtccgaacttggtattccagtaaaatatattggaatcggagaaaagattgaagatttacagaagtttgatgcagattcttttgtaaacgcactttttgaaaaaccagaggaagatgaataaaaacaattatttttatatagatcattgtttaagagatatgaccgatactgttataacatcatggagggatacataattatgatggaaaaattatcattagataaatttgaagaagcttatgagagagtgcaggaagttgttttacctaccaatctggtgcagagtgattttttctcacagatgacaggaaataaagtttattttaaaccggagaatcttcagcttaccggagcgtataagattcgcggagcttactataagatcagtacattaagtgatgaagaaaaggcaaagggacttattactgcttccgcaggtaatcatgcacagggtgttgcttatgcagcaagaaagtttggagcaccggccatcgttgttatgccgacaacaacacctttattaaaggtgaaccgtacaaaggaacttggggcagaagttgttctccatggaaatgtttatgacgaagcatgtgagaaagcaaaagaattggcagcagagcatggctatacttttgtacatccgtttgatgatttagaagtggcaaccggacagggttcgatcgccatggaaatcgtaaaggaacttcctaccgtagatacgattttagtaccagttggtggtggcggactttctacaggtgtttctacccttgcaaaaatgttgaatccaaagattaaagtaattggagtagaaccggcaggggcaaactgtctccaggaatctttaaaggcaggtcatccggtaacacttgaaaatgtaaatacgattgcagacggtactgcagtaaagacaccgggggagacgattttcccatatcttcaggagaatcttgatgatgtcatcacgattgaagacgatgagctgatcgttgctttccttgatatcttagaaaatcataagatgcttgtggagaattctggactgcttacaattgctgcattaaagcatttaaaaccagaaggaaagaaagtggtttcgattttaagtggtggaaatatggatattatcactttggcttccgttgttcaaaacggtctgatccagcgttccagaatctttaccgtttctgttttactgccggatgtaccgggacagcttaacaaagtatcgaaagtaattgcagatgtgcagggtaacgttattaaacttgagcataaccagtttgtcagcgtaaaccgtaacagttctgtagaacttacgattacaatggaagcgtttggccatgaacataaacaaaagatcatcgaagcgttacgttctgctggttttcagccaaaagaaagaacaaccagaggggtataccaataaacgatagatgaaaaaataacatatcttacagcctgtttcatatattatagaaacaggctgtttttttctttatacagctatttttgagaggagcgcagttgtgaaagaaaaagttgatcaggaagaattgcttcggattttccccggaaaattaagaaaaagaatagaagaaaaggtttcctttgaagaggtaacagaaattcgtcttcggacaggacttccgatttccatcgtgacggcagaagaatcttattttttacaaaaacaagaaggatgtggagaaagagaaaaacaagaatactggattttgtcaccggaagaattaaaaattatttttgaaaagttaagccagtattctgtgtttgcttataaagaagaaatcggagaaggatatattacgttaaaaggaggacatcgggcaggtctgtgtggaaaatattattatgatggtatagaaaaaccacagataaaaaatatctcttctataaatcttcgtgtggcaagagaagtgaaaaattgtgcactgccaatcgttccatggttatttgaaggagaagaatttttccatacattactagtttctgctccgggatgtggaaaaacaacgtatttacgagatctgattcgtttattatctgatggcacaggaagtatttccgggaaaaatgtatccgttgtcgatgaacggagcgaaatcggaaaccgcacaaggatgggagaaggattttatctgggaaaacggactgatttactggatcattgtccaaaagcggaagggatgttaatgttgcttcgaacgatgacaccggaaattcttgcggcagatgaaattggggggaaagaggatatgaaagcattagcttatgtgagaaattgcggatgtaaacttttaatgacgattcatggcagttctctacaggatttattttttcggccggtagttggaaaatatttgaaacaatttccttttgaacggtacatatatttagaaaaaggaaaaaaagcagagagaaggattcgtatatatgcgaaacaaggagaggagttgttatggcaaaattattaggtgcatgttttatccttatggcttcctatctttttggagtaaagattatggagcgtgatgcagaacatatccggcttttagaagagggggaattattgtacagaattcttgaatcggaaatccgaaatacaagaacaccattgccccttttatttggagaattgagtgaacgtaccgacagtctctggcataatttttttttgaactttctcttgcgttatctaaaaatatagaggaaagcttttttaatatttatgaaaaaatattagaaaaagtatggaaagaaaaattatccaaggaagagcaaagaatgtttttgaatgcaggaaggaatctcctttcggatgatatgtactatcagcaggaagaaatgagacaactgtctgtatttttaaatgaaaggatttgtcaaatgaaaaaagaatataccggaaaaaagaaagttgtccttgttttttgcctttgtatgggaacattggcagtaatcttacttttttaaaagcgatgtactccgggagtcatttcttcctttgattttgtgagtacacagaaagaaaaggagaaaactatgacgattgaattgatttttaaaatagctgcagtcggaattcttgtaacgatactagggcaggttttgaaacattccggcagagaagaacaggcatttcttgtatcactggcaggactttttatagtgatttcatggatcataccatgcatcagcgaacttttttctgaaatatacagtctgtttgagttgtaaaggagtgagatgacatgcttgtttttaaaatcgtgttaatcggtatcgcaggggcgattcttgtgatgattacaaagcaattcaagccagaatatagtattcctgtacttttaggaatctgtctttttctgatagggtatctgacaactggattagaggaagttttaaaatttgtgcagagtttacaaaaagaaataccgataaataatatgtacataaaaatattatttaaattgctggcgattgcatatatctgtcagattgcttcaaatatatgtgaagatctggggtatcgttccatttcctttcagatagaaacgatagggaaagtatcgatcttactgttaagtattccaattatccaatcattactagagaccgtagagtatctcctagtatcttcttaagtagttaaaaacaaggaaagcaaaagaagaaaggcaggtgagcatttggagagaagaagtgtctataaaagttttcaaattgtcggaattcttttttttatcctgtttttcaccagcatttcgggccttactcttcaagcacagacaacccagaaagaagaggaaattgatattaccgccctttcaagaaaaatagagcagcttgacgagagggactatccggactttgcttcaatttttcaaaagcttgtttccatgcggtttacagaggcggcacaagaaataggacagtggatgacgggagcagtattgcaggagattttctcatcaaagatattcatcggggaactggcaggaattcttttgtttgcttctgtattttcgaatatttcatccgcatttcagtcttatggcgtatccgacagtggatttttaatttcttattttcttgtcttttcgataatttttacaaattttacagttatgatagcgatgtttaaagacaccgttgttttgctttcttcttttttaaaagtattgctgccggtatataccctggcagtttccctttcagggaatctttctacaggcattgtattttatgaatactttatgatcgtagtgctttttttaaactggatatttttaaatgtatttcttccgttgcttcaatactattttctattagaattaatcagccatttctctcaaaaacagaatatttcaaaattgtgtgagggattatattttcttttagcaaaaggaatacaagtcatattttttcttctttttggatttcacttactagaaacaatgatagcaccgtcttttgatggcgcgaaaaacagtatacttaataaaatgatcggattgattccgggagcaggctctatcgttcaaagtgtagcaggcacagcgatcggttcttctcttgttataaaaaatgcagtaggagcggcaggaatcttgtttttgcttatttttttattgctgccgctcgtaaaattatttatctatattttcttatacttcctgttatctgttgtacttgaaccgatagcagatgagcgatttatattatgtattaatgcggcagtgaagtgtggaatattaatgataaaagtcttatgcatgtcttctgtgttgtttattgttgtgattgcacttacttccctgacaacgaattatacagggtaatgccgaagcgggtaagaaaataaaaagcaaaaaagagagaaaaaagaagtaaaaaaaaagtgaaaaagaaaaaaataggagaagaaataggagaaagtggaaacatggagtatataaagagctggttaaaaataattttatatatgaatatcctgttgctgctctgtgataacctgatgcaaaaaactgcttatgaaaaatattaccgttttttctcaggctttttattagtgttgtgcttattaaaacctgtcatagatttcgctggcacagaaccgtatttttatgcttcctttttacaaaaagaatggcaaagtgaacgaaaccggatgaaatattctaaagaattaagcgaagtagaagcagttgtacaaaaggaatgtgaggcggcttacaaaaagcagattgaagaggtagcggagcagtatgggatttcagtaaaaaaagtaacatttcgctgggatagtgcgaaagaacatatcagaaaattagagatagaaggtagtttgaaaactttacaaaatgaaaaatataaaaaatctgagaaacagattgagtctgtacagacagaaactgtagaaaaaatcaaaaaaataatgatgcagttatataatcttaaaaagtctgatattcagatagaggtggaatagagatagaatagggatgaatagaggtggaataaatatgggagagaaagtaccgaaaaaaatgaatctaaaagaaataggaatagaaaaaatcattttaatagcgattgccggaattgttttgctgctggcaaatttttctgaatggaaaaatgcaatttctgaaaaaacagaaaaaaaagaagaaaagacggtacagacagatcaaaatgatgcatatgtgagtgcccttgaaaataaattagtacatatccttgaaaatgtggatggtgtaggaagagtggaagtaatgattactttaaaatcttcaaaagagtctgttttaaataaagatctgtcggaagagaggcagacggaacaggaaaaaaacagcgatacgcaaaaaacaaataaaaacgagaaaaggcaggaagagacgattctttcggacagtgtgggaaattctgctccctatgttgtaaaggaactggaaccggaaatcgcgggaattatcatttcctgtgaaggggcggaaaataaagtggtagcagcatcggttcttgaggcagcgcaggtgctgtttggggtttcagcaaatcatatcaaagtgttaaaaatggagggtgcaaaatgaaaaaagtatttcaaaaaaatcaaattgccattacggcattagcgattatgattgcggtagcaggctatctgaattttacagagcaaaatgcatcaaaagacggggatcaaaagtctggaagttcggtagaaacgattgatactatggatatttcagatggggattctcttataaaagaaaaagcagaaagttcccaaaacgcagcggagaaaaattcagatgaagtatcagaagaatcacagactgccggcagtacagaaacaataggaggagcagttcttacacaggcacaggtcagtgagtatgtggcaggagcaagaatggaaagagagcagacccattcaaaaacaaaagaatcacttaatgagatcatcaacagtgattctgtaggtgaaagtgccaaaaaagaagcagtagataaattggcagaacttgcagatatcatggaaaaagaagcagcaacagaacagcttttggcctcaaaaggatttgagaatgcggtagtatctattggagatgacagtgtggatgttgttcttaattatgaagaactttcttctgcagatcgcgcgcagattgaggatattgtaacaagaaaaacagggtacagtgtcagtcagcttatcataagcaaaatgcagactacagaaagttaaaagatttctgttgcaaaaacagggatgtctgttataattatagaataaatcgatataaaattgtttacattttattaagagactttccatgtgttttttatgcacatggaaggtgcttttctatgagctgtagacaaaaggaggtttccatgggaaaagaaaaagatacaaagataaatcatacggtttataacatagaagatgttggacaggttcagatcgcagatgaggttgttgcagtaatcgccggtctggcggcaacagaaacagatggagttgccaagatgtccgggaatattacgaatgagatcgttagtaagcttggaatgaagaagctgtctaaaggcgtgaaagttacgatcacaggaacacaggtagatgttactctgaatcttgtactgaattatggtgtgagcattccgaagacttctcaggaagtacaggataaagt

SEQ ID NO: 449 - DNA, 19009 bp, Eubacterium hallii
tctgtatatccgcagggatatgtaatcctttcccctgtaaaaaacgcataacctcaagtgcataaaaatctgagacagcaaaaactgctgtaatattattctttagcagttctgaaaagttatcctgataaaagcatatcctttccttttccgtctttggaatctgccagatcaatgttttccccggctcaaatgctttacaaaatccttcgattctttccttatccatacatataaaattatctgctatacataatgcctttttatgaccaagttctctaaaatactttcctgcctgataaccgccatcataatgattaattaccagattaacaactttagaacacttttcaaaataaccgtcatacacaacaaacgatattctcatctgattgcgaagcttctcataatccgcttcacaaaaccccatgagaatcagaccatccatattccacatcgaagcaaacaccgggatttcactgatatctgatgttgtttttatcatcagaaaatatccttttctattcacctcatgggaaagagcattcaacgatgacatcacaacccatcttctaaaacccttccctcatactttatgttatcattcaccaccactccgatgattcttgaattatttcttgcaagcaaaatacctgccatattcggtatatatcccgaactttcaagttcctgttgaacacgctttactgtttcatcagaaatcttttttgttttaccatgaatcacttttgagacagttgcggtactaagacctaacgcatctgccacatccacgatccgaaccctgttctgcgccatatctattccttcttttcctcatattttattacatcgtataatagaaatactttttttacaaaggttaaacgtgtaacccattacaaaatttgtactcagtttttgtaacattttacaatagcaagcatagaaacagcaaaatgtggacaaaaaagcgacagcctgatttacattttgtatttcaggaaactgccgcttctttttcttctttattctgtttttcttcctccaactctcggaggacttcttcgccgtacttatcgatcatccatgccagaaaatcaatgcaccgctcaaattcaatattctgttgcataagctcctcccgttattgttttaatctgagcttattttacagaacctgccggaaaaccacattgaatagaaattgattgtaaatttacacaatcaatttaaaaatatcctcattttcttgaatcaaatgtatgttcgtgctatgatagatatactcaatttttacttctttccgtatctgcgaaaactcttataaataaaaggcagtaaggctattgccatcactgtatacattaccattacaagcggaatttgtcgaaatacacaattcccaatctgataaataagtgggacttttacacttgcctgtacatttgtcaaaattgttggtatcaaattgaaaagcgttgtatacccagaaagtgcccgtcctataaatggcaataagcaatataaaaagaacggaatgcaaacagcgacactaattgtatgcattttagccgctactaacatagacactgaagccgccagcatactggctataaatccacatacagctgtcaacaaatagtattgtccatatgacataatgtaaatactatatgcctgatacatttggtaaggtgtattcataccactggttcccataattccaaaacaaatcacactaagtaatataattcccatacaataaatcataactgtcgtaactactcctgccagtatttttgttttaacagcttttgtacgtccatactttgtagagaaaaatactgcatctgcttttgtctgaaaatcatctgcaaatattccagcacaaataaaaccaactatgattgccagaataatagaatacgtttctacatacataatcatagtatcccatgaactataagattcgtattctactggtaattttatttcattatatttcttttccaagtattttttctgaacagcagtctttccatattcttctgccatctttttcatatttttatgataagtgtcatagaactcttgtatattttcttctgtaatttgattcagaacactttcatcatattctgcatccggtgttgataccgatattataaaactcctaatatcatctatcggttgtaatgtcgttccgtaaatcgcattttcttctgaggattgtgtcatcgcatttttattttgttctataacttttccaagttcatcttctgtcaatctacctttccatgctcgtctgttatctgtaagttttcttgttgccataattccagtactagcatttccattctcatccacatagcgattacttgtaactgcaaatccgctaaaaatgacagcaagtatcaatgcccatccgattgcaaatacattaattttttttgaaaaaattcgttttaattctaatttaagcatcttgtttttcctccgatttttctccaaaataaaatagaaatgcatcttccagatttttttctacagccacagcatcttctgttggcttttctattgaaataattctaagctctgctccggtttttgttgtttttatatttccaaccaaatattcattcatatatttgtctatcatacttctcgaaacattacattgccataccttttctttcatagaagatactaaatcttccgcagtacctgcataaaaaagttctccatctttcattaacataatgttattcgcaatgtactcaatatccgatacaatatgtgtagacaagagcaccaaacgttcttccgacaattcactaattaaattacgaaaacgtattctttcattcgggtctaatccagcggtaggttcgtccaggacaagaatttgcggatcgtttaacatcgcctgtgctattcctacacgtctaaccattcctccagacaaattcttcatttttcttttactgaatttttccattcctacttgatttaataattgcttcactttttttctggcaaacggcatttttaacccttttatagaagaaatgtacatcatataatcatatacggtcaaatctggataatatccaaaatcctgtggtaaatatcccagaacttctcggtattcacctcctagtttccatatatttttaccattccataatatttgtccttctgatggttgaacaatcgtacaaagcatacgcattaatgtggtctttcctgctccatttactccaagcagtccataaattcctttttccataacacaattcactttattaacagcatttacttctccgtattgttttgttacatttttaaattctaatttcatacgtgtaatcctccaaaattttttcatcaaatactaatgacttctgaacacaaaaaacaaaatatacaaaagtcaatatcagcataaccacccataccggagttacaattttctgataaataacatcatttgcaacaatcatcatccataaaccaacccataccagacaggaaatcactgctatatattctgatttttcccatctgctgtacaatacacgaaaacatatacaacatgaaacatttactggaagcaaaaaatcaaccaccaaatcacttaacgagagtattgttgtttgatatgtaattgccaaaaacaccataacgatcaccagatccactactccaaacattaacattcttgctgtacaaatctgacgcagtgtgtaataagacgcctgctcaatttcaatcgcaccatttcttctgtttttccaaatttccgggacaatcagaaccacaaatattgtggcagatattcccataatcttcatcatatcttttatgtctgacgtataattactcaaccatatccatagacacataagaatacaaccttgtaaaatccaccatcttttttttatgaattttgtctgctcatacaaaaattcaaaataagatgttctatgcgattgtttcgataaaattgactctgacaaaatattctgacatgcttttactgttttgttctctgcttcagcccttacatacttttcttcaatctcctctttatattcctttatttgttgcttataattcttcatcttttttcacctccaactctttcattaaaagttcttttgctcttccgattcgatattttacaagagaaagtttgatatgaagtaattctgcaatttctctttgcttcaattcctgaaaaaaatataaaactgccgtttctctaatttcttccggtaactttctcactgcctgttcaatagttaatcggactcctagctcttctacatgatttttactacagtcctctgattttagcagttcctctgatggaatatcttttttctttttgtaataatttttaacggtatttccggcaattgtataaagataattcttaacttttccatattctttatatctatataaattggaaaagaaacgtgtaaatacttcttgtgtcaaatcctctgcctcatagggatcatagatatgtagcaaacaatattgatatatacttgagtaatattttttgaccagtttttcacaagcatcttcatctcctgctcttgctagatgtactaacaaagaatcagttttgtattccattcgcaaatttgcctcctctgttttctatataatataacaatcctactataaaaaaagttaggattttcttttgtttttatttatatttttctaaatattcttccaaacataaattttcttctttcattattttagcgacagtcgttccaacataacggtaatgccatggttcattactaattcctgttatatccgtgaatctacttttttaccgttcgataattctgtcaattctacttgataattatttggaatataatgatttcgatcgaccaaaataagattccattcacccgaagtgtctgcaaaggacttttctgactgcaaaattttcggtaatgttaattctccaacctgcacatcgatttttattatacagatggtcacaatccccatgcacacattcttcttactgtccgaccactaaatgaaaatggaacatggcagtataaaaccgaaaaagaatatctctgtatcaaagatggggaagaaaaaggatttactgcttttgaatttaaaactgctcaaaaacagggatgggaaaagcaatatcgctataaagttgggaaaaagaaagaatatctgactccatcttccgcacaggaaaaaggatatgaacggattgataagcaccccaagagcagccgatatggcagacagaatcctatttccgaacaatggaacagtgatgaacaactccatatcgggagagcaaactgggcagatgccgtaaataaaatgcttgcacgtaatcagataaatgctactattgatcaccgcagctttgcagatcagggaatcaccgaacagccaactatccatgaaggctacattgcccagaatatggaaaagaaagacatgatagcagaccgctgtgaaatcaaccgtcagattcgtgcggataacaaaatactccgagaattaaaagcaaatgtagcaaaactggctgaagctgtagaaaagtctgttccgataattgcagaaacactggaagcaatccgaaatcacatgatttttacacaatatcatttgctccacaatgagatgcaaaaagaagtgatccatgattggatgaatcattttaatccaatactgaataaatacaacacagttaaaaagaaactcaaagctaaagttacggaacggaaagaactgaatgtgcaaaaggataaaaccagtattttgaatcccatccagcatataaaattgaatcagcagcttaccactgttaccgaagaaattgaagaactgaaatcaaggaaagagcagctaatcttccaggcagaatgccctaccgataaagatatgatgaatctatccaaaaaatatgaccagatgaataaaaatctggatatcctggattctcaggacatctcgctcaaaaaacagcttgaaaaagatgccgccgctttccgggaagaaaaatttcgtcctgaaccagaacagtatacagaattgctggacacccgaatccagatacgtcctgattttcgggataagctaatcgaacagctcaaaggtactttcggtaaatattatgactatcaccgtcgtgatattgccgccaatgaggtagattatctcaatgtggaggatcctgatgttttctcccatcgtgcatgagaacttgaatgtcagaggaaacaggaaatgcggcgaaatcagcctgttcgatctaagaaaaggtcacatgatatggaattataatttcctttaaaaagaggcgcatggatcagcaaatccatacgcctaattgataccttgtttctattccttgcgaattctttcaacagcactttcccgactcatcttttcaaactgatactttggtatcacatacgcaatcccaaccaaaattggaatcataagcacacatggcactatcgtaagatgtagccggaagaaaaatgctgtaccgagcgtatttactaaaatttgctttgctccaaacacaattagcaatactgcaatcacaaatgcgcctcccaaatataggaatccctcagccaccaacattttcgatatctgctttttcgtcattcccacaacttccaaaagtgccagttctttttttctactaattacagaggttgctgttgtattaaagaaattcataatgccaataaaagctaaaataatgacaagaaaactaccgatcatataatatttactgacaaaccgcctaaagctcgccttcatatccaatacagaagaaacatttatcatatcattttctttcaaaacatttttatcaatgtattcttttacttgcttatcctctcccttcttggcatcaatagtagcatacattgctgattgattttctgtctgggtgaaatactcttcttctgggaccattactgtaatataaacagaatctgcatacggataatccagggaatatggcatcatagcttctccgattaccccataatctttctgctttccgtttccgtactccattttaaaagtctcgccagactgataataagaaactggttgttctgtatatttatcactatagtccacaatcacataatccccacttttaaacgtatcccaggaacatttttcccctttccattctaacatatcaaacaccgcttcactaattccgaggaaatgaacctttacagtattatccgcttttgtttcctcccagatttgcttttcataatctgtccagttttctttgtttttttctgccaatgtctcccacgttttcaaaagtgccggttccatcttatgtctttcttccgaataatacacatatcctgttttctcactttccggacacttattcagaatctctttgatttcaggtgtaataccgttgaaatttgtattcgataaagtgtcggtcatctgatccagttgaaaatcagatgctaaaactatattctggtaagactcaaaatcatatccctgcaccaacatcacaatacagttgaccactaccatagaaagagcgatagaaccgaagatcaatccgattggaatccccactgctgacaatttccatgcctgcatacgtacaatttttttcaattgttttcctgttgttcccacgttcttcaataatccgtaggctctaatatccgttttcacggatatattaaaaatgccccctttcttctatgagattacagcaaacgtagtagtaatgtctatcaaaaggcctttacatattagataaaagcatgtaaaatttcttttacatagcttaattgcggtctatttagcttgtttcttgattactcaggaaaaatatttctaccctcgccccacctgtattttcagaatttgaaagtttaatctctccgccatatttttcagccacagtttttgcaaaaaatagcccaattccataatgggcttcgccatttctacttgtgtcatccataaaaaactgctctgtgccatgcaataatgcttcttttgtaaatcctgatccactatcttccacaatgaatgtcagctgaccatcctgctcctttgcaccaatatagatgatttccttttctttcgtatgctccactgcattctgaatcacattcattacagcccgaaacattggatcataagcaatcgttacctttttatcacttttctgtgccttccagtttattttctgatggcagatttctgccagcccaagtgcctgttcctttatatctgtaaaaaaatcttctaacctcaccgttgtataggtaacatcactgcaattccatgattttgtgacatctatcaactgttttacataactttgtatctgagttgttccgtttaagacataagtaacattatttttctgttccggtgtcagctccgtttctgaaagcagctccgcatttccccgtacaatggtaaggggtgttttaatatcatgtgccaaagcggacatctgccggttcttttcctgttctgttttccattgcttttccaaggattcacgtagtgcgttccgcatatcatcaatagctgataaacagtcatcaaattctttgatgccagaaccggatgtctcatattccagattttgatcctttatttgtccgattgcgtctaatacaggttgcatctgctttttgattctttttccaaaacgtatggacggaatgacgataatcgctatcgctccaatcacagacataatactcatcacattctgaggttctataaaatgctccctcaaaaaagctgaatgatattgaggtatcaggcgatattgcaatacaacatattcattttcccttacaattactttataaaaatatttcccgaatgcagttccatactttgcagcattccaagcaatctgctcgtattgctctggcagatttccgcctgttttctctccattctctgaaaaaatgacataattacaaagtggcggaatcatctcatccgtcacttcatctgcatacaaaatcgtatcatacgcttcattaatcttttgttctgcaaaatttgccggataaatccaccccagactaataaaagtaaacaggatcaaacagatagcaattaccaaacccacgaatgatcccaacattaccagcacatatctcataaaaattctgctgagtgcattgcttctctttacccttcccatttatatccaatcccccagactgtctttatcggtgtataatcataatttgagaattttgctcttatatttttgatatgtgtgataatggtactgtcattgctctcattgtcaaagccaaagactgcttccaatatctgttccttcgagaaaacctgtcctctgtttttagccaggaattcacagatttcgtactctgccttcgtaagcggaagttctttatcatccatcaacagtttcttttgcgacatctgaatgcagactcttcccaaaaccatacgcacagaatgttccctgtgctctctcctaagatgtgcattgattcttgcacgcagttccatcactccaaatggttttgaaatataatcatctgcccctaaagaaagtccgttcaccagactgttttcctccgtttttgccgtaagaaacaaaatcgggcaatccacaatcgtcctgattcttttgcataattcaaagccatccattcccggcatcataatgtcaagtaaaatcagatcatagtgatgcaattcctccatatgaagtttcagcggattgcttacttttgtaaccagatgtccatccttagtcaaaatgctttctatcatttcaaggattgccggttcatcatcaactgccagtatttttgccataactcttcctcgattctattccgatattcgatttccttcccagtggtttacccaacaaaaatagtataccatactaatccctataaatattaagcaacctggtatgaatgacaaccattcacctacactagtttctcccaatacagattgcagataagtatatggtactcttcccgtccagcagacaaatacatatttccacacataatctccaagtccggtaagcatcaatgcactaattagtcctgatataatccctgctccaatggatacaccttttccaaactgaaaagccagaatcagctgccacagataaagtggaacactgcttccccacagcagcaatgctgcaaatatacatcctttcatgatttcgatatcgcttgatgcgattcttccaaatccaattccgaatatgattgctgtcaataggatagagcacagacacaaaaccagtagcatcaacagtttcgataaaaatgctgcaggtttatccggtaaagacaacagattttgaaaatcacctgcattttgttcctgttccatcacacttgctgtaaaaattccaataagtaccggaagtcctgctcctattgcctgataaaatgcaatcactttcatattttcattccatggtgaaaaaaagtaatatattaaaaatataacgctggttataatcggaatcagtaagtgtgccagaatcacagatgttcctttcatctttcgcaagtctgcattaagagatcttccaatcatcttatttcacctctcttctctcaaaccatttcaaaaacagaaccgttacaaaaacaaaccagatgattgagagacacattcccggaacaatgactcccgtatccaaaagaggattccctgcttctgcggcaagtccatttggtaaaacatgaagcaacgggcacatcattcgcatagggattgcagaaacaagtacataccagattctggtttgtgatattaccacaccgctgacggtaataaataggcagacgaacaggtttacaatcattccaaatcgttcacttaaaaataaagctaccggaatctcccataactcagaaaccgtcagaaacaatactgcaatcaacgctcctccaactggaacatgtgtcgttagaagaaagcctccaagcgttgctcctgcaaacacaatcacattagaaaacaaaatcatgtacccaatataaataattttccccagcaacaattttcttctgtctgtgggaatagtcattaaatgatagtattttatctttttctcctgcgccacagaaagataacaaaatagagcaatcatccccggcaacaaaagtgtataccaccagttccaaacactttctgcataagcatttgtcatcccaagagtaaatatagatgccatgacaaatgtaagaagaggaaatccccagataaacttttttcgcatggttcttttggctttttgatgttctgcttttataatattaaccatggatttcacctgctttctggttttttcttaccacattcataaacaaatcttcaagattatctccctgctttaatgctccttcgtatcctaagattccacctgaaataatcccgactttatctgcaagtaactgtacctctgagagaatatgactggagagaattacagtgattccctgttccggaaaagaccggatcagctctcgtaattcctcgatgcctattggatctaatccattcgtaggttcatccaatatcaaaagttccggttctccaagcaatgccattgcaatgcctagtctttgcttcatccccaaagaaaactgtcctgctttcttctttccggtgtttgtaagtgatacaatctgcaagacctcatcaattctgttttcatctgtaccaagcaataattgtcttaccttcaaattctctctggcggaaagattttcataaataggcggattttcaattaacgctcctatttttgataaatctttcctatcccatgttattccatcaaagtaaatcttgcctgcagttggtttcatcataccggtcagcattttcaatatggtagatttaccagcaccattcggtccaagcagtccataaatctgtcccttttctatattaagtgaaacattatttaccgctttctgttttctaaaatatttacatagattttgtgtctgcaacatcattttcatctttaccattcatccttccttctatatttcatttcttactgaaatataatctatcaggaaaaaataaagatttgatgaagatttattctcgtatggaataaaccatcaattgaatatcattatcagaactcggctttccactgaaatcagcaaaactgttacaaatacgaagtcccagtttaccgaatatctccgtgatttcatgcaaactatataaccttataggatttccttcttttatttcaggcttataaaatgcttctccatacatatagtctacctgcccatatatcagtgtttttctttccttctcccattcaaaagcagataatgtaagtcccttttctcctgcatcccataacttacacgggaaatgtgtttctgcatagcttccattcatgatatccataaagtgctttccacctttttttaatgctttcgcaatgacagaaaaaatcttatgattttccccatcgtcttcaagatatcctattgctccatccgccatattcagcacaacatcaaattccttatcaaatgtgatcgtgcgaatgtcctgacaaatgaactttgcattcaaattttctttttttgcctgctcgtttgtataatctatgtacgccggtgtaatatcaataccggtaacatcatacccacgtctggcaaactccagtgagtgccgaccaaatccacatgcaagatcaagtattttttccgttccttttaactgtaactgcttgattagaaaatctacttgtctgcctgtatcttctacccatgacatattctgaatatccagcgtccaatttttctgataccagtctttttccattgctttcatctaaatttacctcctgcttttcatcattcaaaaatctgtcccagaagttttttcttctccatatacgggaactctctatcaaatgcctctgcttccttttcatttaccagataccctgccggaggtgcatactctcctgtaattccattaagatatcccggtatcagttctttgcacagaaagaaagatgcatcctcgccttccggcaatccatgatagcggatgccaaactcgcttgcctgtttaaatccgctttttccataaaaatcaatatttccttcaaagcatactgctccgcatccaagctcttttactttttccagagaattcgtaaacttccactggtctgccacccttcctgcaggcattccgtttttacacatccagttttaaaattatagattttattcacattatttcttgtgtctctgtcgatacccaggcaataaaccaaagcccgatggtagacatcctgatatctgcattttttcagatattcctcataaaatttttcgtgttccctgctcttgaaagtaattgtgcgagaattgctattctctgctcttaacgctgtgtttgtcattttcattttcctcctgaatttttaatattttggtataaaaaagacactccatttctggaatgccccataaaaaatagggacacccgcttttaacaagtatccctataatctatcaatgatctgatagctctctattcattttcatattcaagattctttgtgttccccgtcccgaggtctaacgcaacaacaacggttactttcttcacaaggctcttttctttgtgattttcacctatttttttgaaactgaaaaactccacaaagtgcgtaaattcaaggatttctacatatttttcctttgtagcaacaccacagtctccacatgcaccgttccagggaacatatcaactaaacagcatctcttgacctcataccccgcttccctaaatacaagcagatcacgcataaggctggttggtttacaacttacatataccatttcatctacattgaaattaatgatttttcgtaaagctttcggatgaattccgtcgcgaggagggtcgagtacgagaatgtccggcttctgggttaagttatccacaactttgaggacatcgccggcaatgaattcacaattgtctaagtggttgtccactgcgttctttttggcggcttccaccgcttcttctacgatttcgacaccgactactttacttgctacgggtgcaagcatctgtgcgatcgttccggttccggtgtaaaggtcgtaaacgagtttatcttttgtttccccaacgtattctcttacctgatcatacaggacttctgctcctaaggtgtttgtctggaagaaggagaatggggagattttgaaacgcatgttataaaggtattcataaaaataatcttggccgtaaagtgtttttgtttcatcgctttgtactacgtctgcaaggttgtcgtttaatgtatgcaagattccaacaacttttccatcaattttctgggtgagaatcatattgacaaattcagattcatccagtctgctctgtgtcgtagtgacaagattgattaaaatatctcctgtttttacagagcggcgcattacgagatggcgaaggaatccttcgtgacgaattttgtggaagtaggtttctcctttttctttaaagtattttaagattgcctggagaagtacattgaaatctgggtctacgatgcgacagtcctctaatgttacgatatcatagaaactgtttttcttatgcattccaagagcgagcggaccgtctttttcttcatctccaaatgtgaattccatcttgtttcggtagccttctgtgatcgggcttccataaatattttcaataacaaaggaaagaccgtttttttcgattaattcttctacctggcgtttctttaagtcaagctgctgttcataagaaagattctgataacggcagccaccgcaaataccgaaatgtttgcatgctgctggctgttctatcggggatggctcgatgacttcaagaagtcttccttcgattttatctcgtttctttttattaatggagaagcgtactacctgaccttctaacacattttttacgattactttctgcccctcaatatctataattcctttattagggaattcggttcggatgacttttccctcaaaaatatctccttttttcataaaataattcctttctataatacataaaaaatggaaaggatgctgcaatgtacacccttttccattatattcaagaatgtcccggctttcttgcacgagtacatttatattattttttaaattttcagttcggtaaatttggatttataatatccatgtccgtaatgggcctcgccttcatcatcaatttccataatgagaaatgttggcatatgatcaggttgtcttgggtaagaaacgcttcccggatttaatatcgttacatcttcatcgatttcgatgtatggtttatgcgtatgaccaaacataacaatatcgatattattttgaagtgcatactgttttaagcgttctacaccgcgatatacgtaaaaagtatgtccgtgaacaaccagtaccttataatcgccaatattaaaaatgtcttgtgcaggaagatcaagattatagtcgttgtttccggaaaccatatgtaccggacaatctaccaatgaacggatataatcgtctcctcgctctacatctccacaatggatgagcatatcgattggtccaacctgctcgattactcctgccacatcatcattacgtccatgcgaatcactgattaccaaaattctcattttattttcactcatctatttacaaaatctcctttatctggcgtaaagcctttccacgatgactgatttcattcttttcttctgctgaaagctgagcagttgttttgcctctgtccggaagatagaaaataggatcataaccaaaaccattctctccggctggctcctgtgcaattcttccttcaatggttgctctgcgagtctctatcgtcccatccggaaatgccgctgcaataacacagacaaagcgggcactccttacaatatccggaactccatgcagtctgtctaaaataatctgattcttaatacgatacgatgtgttctctcccatgtatcgggcagaatacacacctggttctttattaagataatcaatttccagaccggaatcatctgctaaaacaatacttcctgttgcctccatcaccgtttttgctttaatgatggcattttcctcaaatgttgttccatcctctacaatatctacatcgactccggcttctttcatcgagaggatctcataatccaagtcaccgaggatttcgcgaatttccttcatcttgccttcatttccagtggcaaatattaactttttcttcaaaattctgcctcctacaaagctcatactttatctatatgacttctaatatccgcttattaactgcatcgtgtgacagtcactaggtcactacgcttctgactgctctggcttttttctccttggcggctttggacctgggaacatatagaaatacgtcttcatcattccgttataaatcttacggttcttcgccgctttctttccgatataacgttctgcatcctcataagctgtgataacatattctgaccatccatcaagtcctgcgaaagcttttcccatatcacgatataacgccggaagatcttctttttcttctagacgttctccgtaaggaggatttgtaataacaaagccgtacttctttggatgactcaaatgatgaactggtcgctgctgaaaatgaatgaatccatccacaccggctctcttcgcattctctcttgccgcctttacgatctgtggatcaatatcgtatccctgaatgtccatttccacacttaaatctaccagagattctgcttcttcaaatccttttgcaaaaagcttcggagatacaatattctcccacttctgtgcctgaaattcccgatgcattcctggtgcgatattcgctcccatcattgctgcctcgataggaaatgttccacttccgcaaaatgggtctacaagaatacgattcttgttccaaggggtaagtttaataagtgctgcggccagtgtttcttcgattggtgccttacttaccatacggcggtaacctcttttgtgaagactttctccggaagtatcaagtccgatcgtcacaacatccttataaataatcactcgaaccggataatcttcgccatcctcttcaaaccagttaatatgataatgttccttcatgcgctcaaccatcgctttttttacgatagactgaatatctgaagggctaaataacttgctctttacggaagttgcctttgttacccagaatcttgcatctgatgggaaatactcttcccatggaactttcttgacattctggaacagttcctcaaaagttacagccttaaattctgccacttttaaaagaattcgctgggttgttctcaagaagatattcgctcttactaaggcttccatatctccggcaaacattacctttccatcttccaccttcacaatctcgtatcccagatcagcgatttctctcttacacactgcctcaagtccaaaatgacaaggtgctataaattcatatctgttgcccatctttcctccattaactgtatcttttcattatatgtttctttatatttttctttatatctttcttttaacttcatatagatacactttttatctttaaaaaatatttcttaatagttataattgtacttaggaaatgtttctgtgtcaagaagtacgcaccatcgtccataagtcattcttctctttttccagatatcctttataaaacataatcccgccaacgacattatatgcgtgaattcccatagaatccaactttctcgcggccagtatacttgtggaacctgtatcacaatacacaaaaaccggctgttctttttctacattaaaatctgcctctatatcaaacttttctttcataatatctgtaaaaggaatatttaccgccatcggcagatgtccctttttaaatgcttcttctgaccgaacatcgacaagtaagcctttagatgcataactctgctttattgcctccgatatcgaaatgagatcaaacataccctcgccttcttccacctctatatatcaacatatgtatttttctaaaaaaagtgcacttctgatttaattgaatagaacagacaaaaggggatgtcgcaccaaaaacagccctaccctatggcagggattcatgcatttgcaatggaatcgctgccatatttttacgaacaagcgtgggacctatggcataatcgcagacgacttgcgttttactactcaactttcgaacgtttatggaaacgccattcgcgctaaactcgctgccgctcaaacaacgcgctcggtggcgggttcgttctcaagtttcgtgacgcaaaacctgcaatgcatctgctctttataccataggcatccacgcttttttcataaatcttcggaattcgattccattgcaaatgcatgaatccccgccatccgccacgcccgatgccaaaagctgtttttattttcccagtctgtggcaaagcaaaagaaaaaagccgaacttttttgcaaagaacgactctggaaagacattagccgaagtgacggaaaagactctacaagatcaacgaggaagaagggaaaatctggaacggatcaccagagagtatgggacacagctgaggatgaaccagagtatccaggctggtcttttgtctaagacagaaggcttagataagtgcgctttttcagcagtacaagtactgtaactgtagccaaaacaagcagattctgctgaaaatgtgtacaaaaagtccgtcgcagttacggtcgttagaccgttactgcgacggaacctttggctgcaaataaaatccgtattttctatgctgcgataatctttactgatacgctacgct

SEQ ID NO: 450 - DNA, 18786 bp, Eubacterium hallii
gagccatgcctgatgtgcttcttctcgaaggagtgctacgtccataaggctgagtagtggttttggcgggtctccatagcgatcggtcagttcttcgatcatatcctcatattcttcttctgtttcaatggctgcaatccttttataccaggaaagtttttctgcttcgcttttgatgtaagtttccggtatataggcattgatggacagatcaatggatgtggtaaaggtatcgacttcttgttgttcgcctttcattgttaagacggcttcgtttaacattttgcagtagaggtcgtatcctacagattccatatgaccggattgttctgcgccaagaaggtttccggcgccgcggatttcaaggtcgcgcatggcaattttgaagccgcttcctaagtcggtgaattcacgaatggcttttaagcgtttttctgcttcttcttttaaaacggagttccttcgatacattaagaaggcgtaggcagttcggttggaacgaccgacacgacctcttaactggtaaagctgtgagagaccgaataactgggcatcctgaatgatcattgtgttgacgtttggaatatcgagtccagtttcaataattgttgtcgatactagtacatcgatttctttgttgataaagccggtcataatactttctaactgacgttctcccatctgtccatgtgcgtattctacggttgcatcgggaagcagcttttgtagctgcgctgcgacttcatctatgttgttgactcgattgtatacataatatacctgtccgcctctgccaagctctctctcgattgcctctcgaacaagttcttcattatattccatgacataggtctgaatagcccggcggtctaccggagggacttcgagaacgctcatatcgcggattccggcaaggctcatatgcagggttcttggaatcggggttgcagataatgccagtacatctacgtctttttttaattgtttgattttttctttttgttttacaccaaaacgttgttcttcatcaatgatgagaagaccaagatttttatatttgatgctttttgagagaactttatgtgtaccgatcacaatatcaatacttccatttttcaggccatctaaaatacgtttctgttcttttggcgtacagaagcgggaaagcatggcgatctcgattggataatgttccattctttccttaaatgaattataatgctgctgtgctaaaatagttgtcgggacaagataaacgacttgtttgctgtccatgactgctttgaatgccgcacgtatggcaacttcggtcttgccgtaaccaacatctccgcagatcaggcggtccattatgcggtggctctccatgtctcgctttgtatcttcgattgcatttaactgatcttctgtttcctcatatggaaataattcttcaaattctttctgccagacggtatcttttccgtaagaatacccttcttttgcctgcctttctgcatagagcttcactaaatcctgagcagcaatctgtacctgtgagcgtactctgctctttgttttttcccattcagtaccgcctaacttattgagttttggctttctcgcactcagactggagtacttctggatcagttcaagctgggaagcggggataaaaaggttgctggcatctttgtattcaatattgatgtaatccttcgtaattccgtcggcctctattttttccattccgcggtaaataccaagtccatatctttcatgaacaacgtaatctcctacggaaatttcagaaagagaattgattttctgcccgctgtactggctttttttctttttcttttttacttttctttctttaaaaatgtctttctctgataaaacaacaaaccggattgccggatattcaaatccgttttcaagacggccgcttgcgaccataatctcacccggctcgatcatccggttaaaatctgcagcaaaatacgcaaggagtccgtaatctttgatgttttctgcaagacgttttgctcttgttgttgaggaggaaagtagaaggatacgataattttcctttttccagtgttctaaatcttttattaactggtcaaagctattgttatatgaaaaaatagattttacttcgatatcgcagattgtttttggtttataaaaggcatagtcctgaatgacggaacttagtaaaataagtggcttcgccatcacttttgataaaatctcttcatagccaaacagcagatctgcctgtcccggcagaacatatccaccttctaaacggctttgcatacagagaaaaaattcttcttcatatgtctttcctttttctagaatacgatgcggttcgtccagaaaaaataatgtattttccggtaaatattcaagtagggatactgttttctcataaaaataagatagcagggcttcgcttccttctgctgttccaaaagaaagaagttcttcttctgttcgtatcgtcatcttgcggagacgttctttttctgtaaggcgcttctgctttttaaatatttcttcctgtttcttatattcttccttcatacaatggactgcatcgccaatcttatgtcttgaaagaatcatttctgttgctggatatatttgaactttttctagcttttctacacttctctgcgtttctgtatcaaaagaacggagtgaatccacttcatctccccacagttctattcgaaccggcagatcttctgtaagtgggaaaatgtcaataatcccacctcggataccaaactgtccgggtgattccaccagaccactgttctcatagccaagctctgaaagttttaatttaagtgcatctgtatcaatgatcgattcaaaatcaatcgtaagacagtgttccttaaagtcctcaaggggaatcattttctccataagcacatcaagacaggcaacgatcgtcagcggctctcccgccataagcttctttaagatatccattcgctgccgctcgatatgattactgtgtacatccgcgctataaaacagtacatctcttgaaggatatagaacggtattagaatcaaaaaaacgcaaatcctgatacagttctttcgccttatcttctttataagtcagtacaagccggcatgggaagtcttctccaaggtttggaataaagtgtgctttttgagaatcaacacaaccattcaggacgatgggataagccttcttttccattgcagttttcatatcaatataagtatcaaattttaaaagagggttagataaagttttcatgatacctcctttcattttggttgttgcacttttctgttgcatgctggagcgtggtcttctaaaaatcaagtatagaaaaatttatttagaaaaagcatttttatattgctcctatttcatagtactctaaagggatgattttattccgttgcgctaaacattccattttgcccaataaagcaagaacttctcgagaacgagctcgaagttcttatggtcaaaattccatagcgcaaagtcataaaactcattccctttagagtactatgaaatattccagaacatcttgctctttccaaataaatttttctatacttgattttactattatttatagcgcaacggaaaaatattttctctctattccaaagtttttcttttctttttccctacactatatttgttcattgcttctgcgaattcatcctgagcaaaaagttctgctgctttttctgccttgtctaaagattctgcgagtaattctttttcgtcatctttgaaatgtccaagaacataatctgcaagatcctgtcccggatgtttttccccgccaataccgacacgaattcgtggaaaagtgtctccacctaaatgtttgataatactcttcattccattatgcccaccggcactacccttcgtgcgcaggcggagcatgccgggttctaaactgatatcgtcataaattacaaggatatcgcttaaatccagcttataaaaatccatgatcggacgaagactttccccgcttaaattcatatacgttaacggttttacaagaagtactttactgccgccaataaagccacttcctaccattgccttgaacttatgctgattcatattgattctgtttgcttctgcgatacggtcgattgccatgtatcctacattgtgtcttgttcctttatactgatctgttggattccctaatcctacaattactttcattctatgttcctttcctgattttatttcttctgtgtttgttttttcttgattttgtagtgtctgttccttttgtttttctttttgcttttcttcttgtttctcttcttgtttttctttttgcttctgtctttgtctctctaactgttcctgcatttttactttttgctgctgcttttttctttgctttttacgttccgattcccaggaacttacggctgcctcggcatcctgtgttgcccacttttccggaagccttccgttttgccccttaccagaagcgttatcaaatatattctgactgatgctgtcaggattcttcttcctgcgatgtttcggacgatactggttccactcctcataaaatggttccggttctgacgcggaattcggcagctttttgccattgccaaaataatagtctaccactctctccgcagatttgtcatcaaaataatcattatgcaaatgcgcaaagctttctacttttttcaaatcccactgctcatttttcatgcagtcaatcaaatcctgcatattttctacgatcggaccgggtgccgtcttttcataatcaaaataaaaacctcggtctttgcttaaataccagtctttgtcaaatgcataaaggatgatcggacggtttaaaagagaatattctactgcaatcgaagaatagtccgcaattaaaatgtccgtcatgcaaagcagcttacggacattcggataatcggtcatatttgctaccgtttcaggtactttggcagactgaatctgtggatgaagacgtaccattaagaaatagtctttcccaagttctttctgaaatgcatcaaaatcaaacgcttctaaaagctttttatcatgttcttcctccccacgaaaagtcggtgcataaagaacaagcttctttcctttcatttccggatattgttcactaagttcttccttccacgcagcaatatcatgctttctgaaaaaatagtccacctgtgggcatccgatacagattaccttttctttcggtgctataaaagcctctgcataattatctctgatatttttagaacttgccagtatatgatttgtattttgggttgctgcttctaactcttttaacactgccggatccgtttcagaagaaccgccaaacttcttaaaagatcccatcccatgccaaagctgaactacctttgtctcatccgacagtttcatatatccaagcggcaaaaaattgtcattcaaaaaaatatgggatgaagtcgccattcgaaaagcctttatagtaaaaagctttagcaagcctcccagattacgtggactcacttcataatctgtatgcgtgataatattaaaatgaaacggtaaccctcttttttcacattcattttttatctcaaacaggcttcctgttccaccggtgtttaacttctccacgagggtgatctgattcttctttaccttccatttgcgaaagaaattaaaaaagcctgcaaatattttatttgtattcaatgtatctaacctccactgtacatctaatgtactctcggaatctttttgtgccgttctgtaatatatgattaaaaatcaattctcaaaagttctacctgatatttttccataacaacataaacaacatatgttttttagtatatcatagattatgcattttctaaaaagaaaatttttcgaatagcaaaacgactcttgcaattttcaaaaatcttcataaaaatatagcaggaattccatatattatacagaaattcctgctataaggttaagagccgttttgtgtcagcccctttatcttctaagttttgctacagttatatttataatgctacctctgcttctccgactgtttcctcttcccccgaggccatgattgcttcgtattcctgaagaatacttttctggatgatgtcacgagtatcagaattaatcggatgtgcgatatcacgatactccccatcagatgctttgcggcttggcattgcgataaataagcccttttctccttcaatcactttgatatcgtgtacaacaaacgcgttatcaaatgttacggatacaaccgctttcatctttccttcttttgctatctttctgattcttatatcggtaatctgcatgacctgtcctcccaataatgttattactacttacagaatgtaccgcacattcttctcaattacaatcttaatctcatcatcggttccgacatagttcgttcctggacggagagtatctctactctctacaatacagttttcaatataggagtcatctccgatatatacatcattcaaaatgatggagttcttgattgtacaattatttccaatatatacgtctttaaagatgatagaattctcaactttaccgttaacaatacaaccggaagaaataatactgttcttcacttctgctcctgcattatactttgctggtggcagatcatctactttagagtatacatccggatactgtttgaagaagtaatctcttacgtccttcttcaagaaatccatatttgtcttataataagaatctactgttgcaatatttctccaatatgtatcaagcttataaccgtaaatcttacgaacatttctataacgaacaagtacatcctgtacaaaatcgtgtctgtcttctcttgcacaacgctcaagaatctcgatcagatgacgtcttctgatcacataaacaccgatagaaacattattagaagaagcaacaagtggtttctcttcaaactctgtgattctttcgttctcatctaacttaagaacaccaaaacgtgtcagatcatcatctgtatctttcagtgttgtgtaaacgacagtaatatctgcgttcttagcgatatgtgcttcaagaaccttaccgtaatccatcttgtatacgccatcacctgttgcaataattacataaggctcatggctcttcttaaggaaatcaatattctggtaaagagcatctgctgtaccctgataccaggagttgttattctttgtaacggtaggagtgaaaacataaagtcccccctgctttcttccgaaatcccaccacttacttgagcttaaatgttcatttaaagagcgggcattaaactgtggtaataccgctactttagatacacgtgaattgctcatattacttaatgtaaaatcaatcgcacgataacttcctgctacaggaagggctgcgatcgcacgcttatcggataatcttccgattctgttattattaccgcctgctaaaataatacctatagacttcatttatgtcacctgccctctactatctgataatggattcgccgcttgccagaatgccttccggataatcctctgctgttgtctttcctacgattgcgacattcttaccaatcttaacgttggctgggataacagaaccttcacctatagtaactaatccgccacggtaaacattcggtttatacttgttctctgcttcttcaaatacaccaagttctgtgttctctccaacttctacacgctctgcgatgatagacttctctaccttagcgcccttcttgattacggtattattcataataatagagttcgtaactactgcaccttcctcgataacaacaccagctccgataacagagttggaaatctctccgtaaatttctgttccgtctccgacgatacaggaattcaccttagagtctgctgagaaatactgtggtggaataatgtctgtctttgtgtatattctccagaattcttcgtaaagattaaattcaggtataatatcaattaattccatgttcgcttcccagtatgcggaaagtgttcctacgtctttccagtaaccctgatagttgtaagccataatcttatcaccacgcttatggcagtaaggaattacgtgcataccaaagtcacagccaggctgttcagataaagtttccagagcttcctttaatacttcccagttaaagatataaatacccatggatgctttattacttcttgggttagctggtttctcttcaaattcgagaatctgattattctcatctgtgattacaagaccaaaacggctggcatcttcccaaggtacttcataagtagccagtgtgatctgcgcattgttcttcttatggaattcaagcatcagttcgtaatccatcttataaatatggtctccaccaagaataattacataatccggatggtaatactccatgaattccatgttctgataaatcgcgttcgctgttcctgtataccagtccgtattctgactcttctcgtatggaggaagaatagataccccacctatattacgatccaaatcccaaggaataccgataccgatgtgctggttcagtcttaatggctgatactgggtaagaacacctactgtgtcgattccagagttaatacagttacttaacggaaaatcaatgattttatactttccgccgaatgctactgccggtttcgctaatttagaggttagtacgccaagacggcttccttgtccaccagctaagagcattgctatcatttctttttttatcataataatcacccctttgtcacataatacttattatagcactgaaattcccaaatggaaagcagtttagcacaaaaaacaaaatatattttttatttttttatatattttgtatcgtttatatggttatcttttacatttaaatgtagaaatcccacgaaaacaataggacattataatgaaaagtgccctattactggctgttttggaaatttttcaagataccctgatacccctactataagatgtgtacagaagagaccttaagtatcgcaattctttcttgaatctcgtttatctgtgcgctatactataaacgactttttaataattaaactgatttttttcgccatatttatttatatgtactcactaagtcctatatgacggattttctgagacacatcttgtggcactggaggtaaatatgtatacaattgattttcaaaagccgattcatgttcattttatcggtattggcggcatcagcatgagcggtcttgccgaaattttattaaacagacatttcacagtgaccggttctgatatgcaggcttccgacatgacaaagcatcttgaagaaacaggtgcaaaggttgttatcggacagaaagcagagaatattaccgatgatatcgatcttgttgtttatactgctgccattcacgaatctaacgaagaatttgctgctgcaaagaataaaggaatccctatgatgacccgcgcagctctccttggacagatcatggcaaactttacgaagtctatcgccgttgccggaacacatggaaagacaacaacaacttctatgcttactcacattcttcttcaggcagataccgatcctacggtcagtgtcggaggtatgttagaccgtatcggcggaaatattcgtgtcggccattctgacctcttccttacggaagcatgtgaatatacgaacagtttccttgaattttatccattatattctattatcttaaatgtagaagaagaccatatggatttctttaaggatattgaagatattaagaattctttccataagttcgcttctcagactgcaaaagacggacttatcattattaacggagatatggaccacacagacttcatcttaaacggtcttagccagaagcacgttacttttggtttaaaccctgacaatgattacactgcagcagatattacatttgataaagagggaaatgcttcttataaccttatcgcacatggacaggaaaagggccgtatcactttaaaagtaaaaggccgccacaatgttatgaactctttagctgccatcgcatgtacagaagcaatcggtcttcctttcgatacgatccgcaaaggtcttttatcctttggcggcacacaccgtcgttttgaatacaaaggttctcttggcgatgtaactgtaattgacgattatgcacatcatccaacagaaatccgcgctactttatctgctgcaaaggattatccgcatgatgaactctgggttatcttccagcctcatacatacacccgtacaaaggcgtttctccctgagtttgcaaaggctttagagcaggcagatcatgtaattttagctgatatttatgccgcaagagaagtagataccggagaagtttcttctagagatgttatgaagcttttgcaggaagatggacaggacgtacattatttcccaagcttcgaagaaatcaaagatttcgtaaaggctcacgtaaaaggacatgacctcctgattacgatgggcgcaggaaatgtcgtagaaatcggagaggaacttctggctgaaaaataagttctaaactattaacagataaagtagatgtttcctaaaaaagataccctatatctatggctctgtcactgtgggttgaatgttcatttaaacgctcgcattcaatcctcgttctaatgccacagagatagggtatcttttctttttggaagctttctctggctcgataggtatccagaataagttatccacattatccacaattttaaatttttttctgagggagttttgaggttttccccaagttgtttacattttgtccacattgtatttttgtaagttcacacctatatcttggaactcatcaccctttttgaccagttttctccccaaaatatcgagttttacccacctatccacaaagttatccacattatccacaaaactatccacacaatctatcaaggttttatacaggagttatccccaattctatccacattctccccagatttgaaactgtattttttgttgtgggtgtgctattctatactcagaagcacaagataatcaccagactacatatataaactacagatgatagaaataagaaataaggggtataatgaacgataagattactttactttacaatgtacagaatgaagttactgttctgccaaacaaatttattgatgaatatatgataaaagcggatggagaatatgttaagatttatcttctgattcttcgtctgcagggtatggggcttcccgtagatgtggatcatcttgcggatcatctggaactgacacgaaaagatgttttacgtgcgctttcctactgggaaaaagctggtcttttacaggctaccgagccttctgtgccagagaagacagcttctgcggcttctacagggacacaaaaaggggcttcttcacaacaggggacgactccttcaccgacgattacttctgtaccggagaagactgcattaagtcctacggatgtggagaattctatgaaggataccgatcttgaacgtacgatttatatggcagaaacttatattggtcgtccattttccacatcagagctgaatagcttctgctacattaacgaccagcttcacttttcttctgatctgatggagtatctgatcgaatactgtgtctcccgcggaaagaagagtgtccgttatatcgaaagtgtagcgatcaactggtatcagcagggcatcacaagtgttcaggaggcaaaggagcaaagtacattatattcacagaatgtttttcctattatgaaggcattcggcatttcgaatcgtgatcctggctcagcggagcttgactacataaagaagtggaattctcttggtcttggcaccgatattattattgaggcttgcagccggaccctgcttgccacacaccaggcaagttttccatatgcgaataagatcttagaagactggaagcgtcttggtgttagaagcacttcagatattaagcatctagatgataaacaccgttcttcgaatgcggcctctcctgcctcggcttcttctgccggatatgcgcagggacagacacgtaaaggaatgaccggcactgctgccaggaagaatacatccaatacatcggcaaatcagttccataattttgagcaaagaacttatgattacagcgatttagaatctcgtcttcttgataagaccaggaggtaactatgggtatttccaccagacaatatcaggatattatgaatgaatatgacgcagtacgccgccgtaattatatggcggaacaggaacgtaaagaacgaatctatgctcttattccggagattcgccgtattgatgaggagattgctcatgtttctgtcgcaaaggcaaaggagatgcttctgaaaaagatatcgaatgcggatgctaagaagtcgctgcagagtaccatttacgatctttccatggaaaaggtcaacctgctggcgattcatgattatccggcagattatcttgatccgatctatgactgcccggagtgtaaggataccggctatatcggagataaaaagtgtcattgtttccagcagaagattcgcgagattctttacagacagtctaatattgaagattctgccggtaacgaatgtttttccgctttccgcacagattactattcttcgcagcgaagcggaagagaacgactttctcctcgcgagaatattgaaaatgttttatcggtaagccgttcttttatcgaatgttttgattcccgtcccggacagaatctttttatttatgggaatgccggtgtcggaaagacatttctttcgaactgtattgccggagagctgctgagtcgtggaaaaggagttatttatctgactgcctatcagttttttgaccagcttgccgactatacatttcgccgcgggacagataatgcgcagacccttcccgcctttttacactgtgatcttcttataattgatgatctcggtacagagctgaataattcttttattaattctcagctttttttatgtattaatgaaagaattcttaataaaaaatctactattataagtacaaatctttctttagaacaaattaaccgttcttacacagaaagagttttttcaagaatcatacagtcctacacccttttacatatttacggagaagacattcgcattaaaaaggctttctcctcccttgacgaataagagaagggatgttataaaggaattgtaatatgatttatctcacataataataattatatgattaaaggagtaaaaaacacatgagaccagatgatagcaaatttgcaaccgttcctgtaggtaagcttggaattattgttcaccctagctgtgcagagcttggaaagagaatcgaccagtatattgtaaactggcgtaaagagcgtgaacatgaacacaaagagaatgttgtatttaaagattacgagcaggatacttatattatcgatgcaacctgttcccgtttcggaaccggtgaagcaaaggcactcatctccgattctgttcgtggcgtagatctttatatccttgcagatgttcttaattatagtttaaaatataaagtatgtggtcatgaaaaccatatgtctcctgatgatatttacgcagatgttaagcgtatcatcggcgctgcctccggtaagccaaagagcattactgttatcatgccgttcctttatgagagccgtcagcataagagaagctccagagagtctttagactgtgcttacgcattgcaggaacttacagcaatcggtgttgataacgttcttacatttgatgcacatgaccctcgtgtacagaacgcgatcccactaaaaggttttgacaatatcatgcctacttatcagttcatcaaggctttacttcgctctacaaacgatcttgagattgataacgaacatttaatggtaatcagcccggatgaaggtgctatgaaccgtacaatgtacttctccagcgttcttggtgtagatatcggaatgttctataagagaagagattattctgttgtcgttgacggacgtaacccgatcgttgctcacgagttcttaggttcttctgttgaaggtaaggacgtaatgatcatcgatgatatgatttcttccggtgaaagtatgttagacgttgcaagagagttaaagagaagaaaggcacgtcgtgtattctgcatctctacttttggtatgttcactaacggactggaatctttcgataaagcttacgaagaaggacttatttataaggtaatcactacaaactgtacttaccagcgcccagacctctttgagcgtccatggtatgtaagctgtgatgttgccaagtacattgctctcttaattgattctatcaaccatgaggcttctatcagtgcaatcttaaaccctcatgacagaattacgaagagattagaggagtacaaacagttccatacaattaaagaagaaaaataataatttgtagatttcgtatagacgaaaaaagaaacaatgccatatcccatctgctctgtagtcgctgtgtttaaaatgctcgtccgcatcttaaacacgctccgaagccgcatctgggatatggcattgtttcttttttctgactatctaaatccacagttgatgagaatgggggttaaatacgaatttatttgaggggctaaagaaacgaaaaccatagacttctggacaatcccctcttttttcctcagactaaaatactaattccttattaagagcagccagccgctgagataaaattttatgctgaattgtaggaatactatggtaaagaaaaaagaatggttataagtattgcattttgtgcctttgcgctgtggaattttgactctgaaaacttcggactcgtttttccgaagttttcgttttttgaggcaaaatgaagcgtttagcgcaaccaaacaaaatcaaacttataatcattcttttttctttagaagaccaactacaattcagctctcaacatcttccttttcagtggtgtctattcgccctcttctccatcgctattttctccgctatcgctatcgtttccgctatcaacaccaccgtctccgctatcatcgttattattacttccgttgtttccactattgttatttccattattataattattatcaatgtagctatcatctttattataatcgtcttgatcataataatcgttggagtcactgccggaatcatcggcttctgttgtgttagatgttgtgtcatcatcttcgatagcttctgttgttgcttctgttgtgctttcggtgtcgtcttcagtagattccgtagtcgcttctgttgtgctttcggtatctcccaaataggattcaaattctttgcgaggtaatccctggtgaatcttattcatgtagtttgtccaaatgcttgccggataagtatttccttttaaattatctacggatttatagacatccattcctacccacactgctgttgtatagtatggtgtgtagccgcagagccatccatctacataattattggttgttcctgtcttgcaggctgccggtatatctacatctaactgacagacatgggctgttccttcgtattctgttacacaactttgcagaacgcttgtcatcattctggatgcgctgctggaatatacggatttggtggatgtatcttccggtacaatatcatttccttttgcatcggttatttttatgatacagtctggtgtacggtactctccatcattcgcaatcgtagcgtaacctgctgccatttctacaacggttgttccatttgtaaatccaccaaggcaggttgtattatatttataatctttcttatcaagacctttaaagttcaatgcttctaagtacttcatacaagtacgtgttccaagttcttcatacagacgataggtcgctacattactggacttctctaccgctcttcttaaggaaatagagccggaataggaatatcctgcgttggatactgcatcgtttccagtcattcggctgtcatctaatgtactgtttggtgtgtagcctttttccagtgccggtgtgtatacgaggagaggctttatcgcacttcctggctgacggaaactctgatatgctctgtttaagccatatccttcctgatcttcttcacgacctcctacgattgctgccacctttccggtagagttatcaatagagacggctgcaccctgtactttgtaaacaccatcatctgttttttctgtaaacatggaaagctgagaggatacagaatcctgaagctgtttctgtttctccatatcaatggatgtataaatacgataccctgcggaatataaactttttttgcatgtattatacagttcatcatactcattgttatagctttctttttctgaagtactggaaaatgttgttttaaattcaaagccctgttctttcatcagtgcttctgttgcacattttaaaatatacgtctccgcatagtcattcgtcgttgtttctttctttggcatgatcgttatattttcatcaacagacttctcatactggctctggctgatataaccgtcctcatacatattttttaaaatacggtcacgacgctttattgtagaatctttatgtttatatggatcgtaacgccccgggctgttcggaatggagcataaaaatgcaatctgggaaatcgataaatcctttgctttcttgttaaaatatgcttcagaagcggattctattccgtaataaccgtttgcaaagtatacattattcaggtaaaattcaagaatctcctgcttggtatacttctgctctaacgctacggcaataaacatttcttttattttacggctgtacgtcttttcatatccaagaaagatatttcttgcaagctgctgtgtgatcgtgcttccacccatcgtaatgtttccccgatttaagacaagagaaagtccggcacgagccacaccttcgatatcaattccatggtgtgtcgtaaaattcttgtcttcgatcgaaataatcgcaagctttgctgcatctggaatatcttcataatctagataagagacatccttttcctgttttaacttctttatttcattcccatctgcatcatatacgatcgatgtctgttctgccttaaatgtgtccttactgctttttgatacatccctgctcgcctctttatacatcgtgacgactggcacacctactctttttattgcgattgcaccaagtacacaaaaagcaattaccaaacaagtaccccatattttaagcacccgccataataatccgttatgtttcttactcatagtcacctccgcggttttgtatcttaccgttgttatgcaatctattataacaccttttctttatctttcccattctacaaaaaaaattgcaagatatcttaatacggtattctgaataaaataccctggattcttccttttcttttgctgtattttccgttataatcagactgttataaaatttaaatatcatgatgtcacgaattactccgcagctaatgcagctcccgtaattctgaaacatcatatcattaaagtataccacaaagaaatggagagattgtgaacttgaaaaaattatctggatatcatctgaaatttattgctgttatttccatgcttattgaccatatcgctgttatttttcaagcttccctctctgaaagtatttactttattttacgggcagccggcagactttcctttccactcttttgttttctgcttgttgaaggcttctttcacacaagaaataaaaaaagatatcagcagcgattgtttatttttgctgttttatctgaactgccttatgatctggcattccgatatctgcccgttgacagaccagattttctcgtacagcttcatcatccactttctgtcttttcagcagccttccaacagcaaaatgtactatttactttatttttaggttttactgccatgctcttaatggaaagaaaacagccgtacggccaatatagtatctataaaaatatcgacaccctgatccttttctgctgtcttagcgaaattctccagacagactgcggagccgccgggattctgtgcatttttcttttttactcatcttataaggaaagagaaaataataccggacttacaataaaagaaagtcttatagacatcgcacccactgtgcttctaacttatatcccacccttcccggtacagatatctgccctcgcagacagcttgcttctacgcttatacaacggagaaaaaggaaaaaatcataaatacttcttttacctcttctaccccctacatttggtggttttgtatttagtcaagtagacgaaaaacggaaaaaaataatataacagctgttctatcgtcgtgaattttaagatgctcatccgcatcttaaaattctctcccaagccacatctgttatattattttttttcgtttttctgactttgataaatacaaaatgagaggacctggggattctttttttctgtgtttgggattcaaaaggaatgaatgccagtagtatttgagaaagagatggggaaggggacggaaggttgtggcttatttcgatatagcctattttgttcattccacgtggagccaacacacagaaaataaaaagaatagaccataggaaatgtaatgtg

SEQ ID NO: 451 - DNA, 18291 bp, Eubacterium hallii
cttacatgggcgaagcgtttttcgaatcggtttatttgcttccacaatagatgctttcttccctacccaagtaaattcgtatgcctcatccccatcaataacgtccgatgaaagcatctgctttaaaagttcgaaattaatcactttcttcccttttccattttcatcaatagtctcagttatacaattaggaaatagagaaccaattttttcaatattctgagcagtcatatctactgactccatccgcattttatccatcttatttatcctcctcagatgaaagcatatctaataattcatctgctatttcttctgccgtcattgtggctgtcgtcattgctaatttactagctaaaataggactataatccattacttgtttttttgtcaaattatgccatataggaagtaacgttttgccgttgatactctccatttgaaataaaccatctagctctgcttttgtccaatattttccctcagctatataattaggcgataatatagcaaccccaaacttagatttacgcaatccatcatcaattcttgctctcatagaatcaccccattttatttttgatttatcataccaaaccttaatttctctgtctttcaaagcttgcacaaaggcttctacaaaatctgctttatcttcccaagcgtgagaaacaaacacgtcatattcgggttcatcccccgaaactgtttccaaaaattcatttttaactttagataaccgtaatgattccaattccgaaatacgttgttcatatactcgtttcatattttcaattgatttttcctgtttcttccgttcgttttgctcttctttttgaagtttaagataggcatcatttcttttcgtacgtttatctgaaatttttttaccataatctgcactcgctgcttcagcttttcttgctttttcctcataattttcaatttgtcgcattttactctttatcatactttcagaggcatttttgctaacacttactcttgatgcttttttatgattgtccgctgcctttctatcttcttctgcttttttcttctccaagtcagcaatctctttatctaaagagtttacttttctctgatactgttcaacacccatgtttataaatactcctctaattctttttttaatatctttaactctctatttatctgcatctgtttattcaactgcttttctttccgaatttgagcctttaaaatatcaatctttttttgcaatatctgtctctgttcatctctagtcacagattcttttaaactttcaccattagtttttatttgtaatttatctcctgcaatctgtctaacataattctcataagctgcatccatgctcagtccttccagatgtagaggtaattcttcttctttcatccattctgtatgataatacctattcaccttaaatactttatttccagatgcagccttctccttaaatccaacccatgcctggtactcgccttgatattctagtaaaaataagatatgatacggtactactttatctatctggtaaagtaatttttcatctaattctggattgtttaaatgaatttcaaaaacttctaattctgttaccttatttccctctgcaagatttgtagttgaaactgctattttgtttttccaatatattgttttaacctgttctacaaatactctttttattgctggtgaaatcgttatattttcgtaaaatttttgttttggaattcgtttattaaactctgtcgtttttggtaatcctatcattctttcaccaacctcctttattttatcacaagaaaacatataagttcaaaatcatctaacccagatacggctgataaaagagctgatgtacctccttcagcaaataaactatcaatatcactttcttctttacaattaataattgaattaatcgcttcactaagaagttcagacatctcgcccatattcttcccatcatctgtttcttcattaaatttttggtaaagttttttaattggctgctttttccctctgcacagcaatctgatatcatctagtaattttttaggattcaaatagtcgcaaataacttctccatccatcccaatataaaccatataaaacggatgaattctattctgattatcaatatttacactattattaatattcttcaatacaaatataacaccttctggtaaatcttctcttgacggaactacagcatgtaaacctttcggtttttgttctaaatctggatgtatttttacatagtctaacaaatcaagtcgaaattcatttaagcccaagtccatgatagaaataccagtagtcatatcctcaatatctactacctcttcctgcaaccgttttaactgttgtttacgatattccaaatctcctttttcttctggatttataagatcatcatcacccgtagaagtcataatagaaattttcatacgtgtttccacacgtccttttaagttaatatattcatccaaatccatatccggccaaaaattcacaagttgaatatattcattcttactcccaatacgatctatacgtccaaatctctggataatacgaaccgggttccaatggatgtcataattaaccaaataatcacaatcttgtaagttctgtccctcagaaatacaatctgttgctatcaatatatctatttctgtattacttccaggcattaatatatttctccctttggatataggagaaaaacatgtcaaaacattatttaaagttgctttaaaacctgcaattgttgtttttccatctatgcttcctgtaattacagctgtgttaagtccatacttatttttgatatgtttgctaacatgtttatataaatattctgcggtatcagaaaacgcagaaaaaaccaaaacttttttattatctggatttatcggatcttcaattttttcatctaataatcgtaacaactcttgcaatttgtaatcatgctctggtgtaatatcagctaccattaatgtcaaaagctctagtgtctccgcatcttctattaattctgaacgccaagttttgtaatccatatctgcaagttcaatcttcactttttttccaactgtaaaatattctgtattcccatcatcaatatcaaaatcttcgtctgaaacttcatacatattaatgtttacatttccatatttttcaaatcgattaattgctgtaattgtatcttcaattaatgctttcatcctctgtaaagttaattgaaaagaatttacggaactttccaatcttttcaaaagattgatgctcattaatctcctaataccttcctcacgtcctgtctgtgtaaggttcatccccttattatgtgttaaatccaaatacttctgcatcttacttggaaatatataattagatggtgtgtaaacacaaagactcaaatgtatcaactgctcgtatatctcattataattaattgcagcattcaaatccgtaagtttcggtctaagtgaaattggcttttttctctccggaaattttcctatttcagtagtatcataatacttttcgatatgctttctagaacgtgctattgtcacactatctagcagctcaaagaaatcgaaatctaacatttgaagcaacgcctctgtcgttctttttgctacatctaatttactccaagaattaaatgctttctgtgcttgtttaaatatttcatctatcgttttacttgtactcaatttcttgtttatgttttctgaatcaccttcataggcaatcgccaactgattttttaaatccacaaatctattattaaccggcgttgctgatagcatcaatactttcgttttcacaccggcacgcataactttatccatcaatttcacataacgattttcctgtgtttttgcatgtgtacctgcaccgttacgaaaattgtgagattcatcgattaccacaaggtcatagtttccccaattcaaacgttctaagtctaatccattagaaaatccatgtgcacgagataaatcagtatgaaaaagaacatcatagttcaatcgatctgaagcaatcggattgttaatataattatccttatatgtattccagttttctgctaactttttggggcaaaggacaagtacactcctattgcggttttcataatatttaatgacagccaatgctgtaaatgtcttacctaacccaacactgtccgccaaaatacacccgttatagcgttccattttattaataatagctaatactgcatctctttggaagtcataaagcatattccaaattttgctttgtttaaatcctgttgcttcatttggtaattcatcttctgatatatcatccaaaaattcactaaatacatgatacaatgtcatgaaataaataaactctggagaattctcattataggctgtagtaatattttcaaccacaacatctgtgacatcctgcaatttttccttgtccttccaaagattctcaaaaagttgtatataagacatcgaaaatggggcatcaaaacgattaatcatattataactgttattaccacgctcgcatccaatatctaccgtggtaaatccactgataggcatatatgcaagttgattcatcttattttctactgtaataaatccacccatattttcaccagttgtattagacttaaaacgtgcctttcttttaatccattctgcacattcttttgcgattgcacgctgtgtcatttcattacgcaacttcaattcaaattctgtaccatagagactattttctcgattaagacgtggtatataaaattcacgtttctgtttttctgctttttcagttacaaatgtcggagatgtaaaaataaatcgaaattcgtctacagattccaattgcttttttaactctttataagcatacatagaaaaacaagcagctgcaatagatactttgctacctttttctattgttgatgccatatcatcacgagcaatttccgtaatattatcaaatacctttacttccatccttaccttctcctcagtacagaaaaacattttatccaattacaataattaagcattaaagcatttttgaagctaaatacccatgataaaagtataccatatttaaataaaatatgatatacgttcatattaccgaacctttttacacgccttaaatatcttatcattttctcaccctaatcaccatatacacataatttctccagtcacgctataattctaatttaagaatgaaactttctcttttattttccaaatattatttcctgattagatactgaagaaaaaattttctaatcattaataaaacagcaataaaatcttctgtaaatgcagatgactttattgctgtaaatatcgttatgataaatttatataggatttctgctatgtccacttgtttttctcacttagagagttttctcaaattattttcataatttttcttaaagtcttgaacattcttcgctctacttttacctcttttccctgaaatttcaaccttcctttctacagatacaatattttcttttctttcaatattcgattaatattgctcatcttttttatttactgattcaaatacactactttttttcttttccaacctttttctttccgtcaatttttaaagttctctcctaacttttcaatctgatttttccaattcatctttatctaccctactttaaataatccggttttccaaataattcttttctttctaccttatctgataccatattttttcttactgccttttcttctagcatcctttcaattcgttctaacttatcttgtatatcctctaattttccaacaatcttttcctgttcgattttccttccaaaatattgtattgctgcatttacaaataaattttctttgggatatttttctttatctctcttttcgatgaatgttaatgattcttctgtcattctataatgtttgtcttttcccatttttaacatttccttccttgttgtattttgtaaaactttgtaccaaatacgggagctatgtacattttctctgtagaattatatcccttttccgggaaataaacgtgtcccacatcagggaactatatcccaaaaaagggactaataagctgtcaagcttattgcaagatacgcattttgtacacacaaaatgcatcttgttaagggagaacccctaaaacccccttcaccgaaacagtgcacctgcataagcctctatgtctatgtaattggaatcttatctatctttttccaatctgctttcccactcgcccttaacatctactcctttcgaaacaaagtatttaaaatttcaagaattattctaagtgactccacctgctctggttctaattcctccaaattaggatttttattaatctgttttgaaatttgttctatctgcttttttatctctgtaaaagttttaatgtttcctttgacaagaatcgtctgatacaggcaactctgtataaagaactttgactttaacattcctgtcaatttaattcgagtctctatcagttccttttccgttggagaaacacgaaaattcataattacatttcgcactctgtttttttcatttttcttgcttctgctttttctttttcctttagactgtgtaggccttcgataaattttatctacctcatacatccttatcctccttgaatctgacacacacatattccagattgtcaaagtacggtgttccgactaaataccaatgtcctcctttttcatcccaggccatttctatccgtgtgtgaatccatttgtcatcaacttttacttctaaaggatctccgcaatggaatccctcatattcccataagtcagatactaaaagtccatatctatcattattgcaattatagcttaaacgaccttcaatcatttttctcctcctctttaaatactttatctaacttatttgccatctctttctgaactgaaggatataaatgtgcatatctttcagtaatcgttatactttcatgccccagacgttctgcaatctgaattggtgaatatccaagattaataagtaatgcacaactggaatgtcttaaatcatgaattctaattcttttaattcctgctgccttactgcctctgtccatttcatggtgaagataactttttgtaacttcaaaaagtctgctattttcatttactttatatagtgattcgatgtaatcctgtatttcctcgcacagaaattctggaagttctattgtccgattacttttttccgttttgggtgaagtaatcattgattttcctttaataacttgataagttttattgattctaagcttcttagattccaaatcaaaatctgcttttgtgagagccaatagctctccacatcgaattcctgtccaatataaaatttgaaatgcataatatgaaatcggtttatctttaatagcttcagaaaatttaagatattcatctaatgtccaaaattgcatctcttttccttttgcccttcccattttcttattagctatacatggatttctcggcagttcataatatttgactgcatgattaaatattgcatttaactggttctgaatacttctaagataagtctgtgaatacccttttccgttctcatccctttgacttaatagctcattttgccattgtaaaacatcaacagaagtaatttctgacaagcttctatccttaaaatatggtagaatatgtgcttctatgatattttctttattatccatagtactagcttttaactgtggtcgtaaatctcccatatagatatcaataaaagcaccaaatcccatattaatatctttactggtctttgccaaaaattcacgttcatacttcaatgcttcttttttagtagaaaatcctcttttctcatgttttctacgcacgcctttccagtctttgtagtaacaagcaacacgccatgtcgttcctttatatccattccatttgtctttatataccgccatatcctaccttctccttcccataatttaaatatggctttcctctcaggaattttgtataatcatcgtgtaatctagcttgaatatctaatgtacccacaagactctctatgtacaaagtagaaatcaaataggaggacatattttttatttcaagagtcgcatctataagtctgtttaaaatgtccgctatatgttcatatcgtaattttaagaaacgagatttcacttcttcccatggataaaacgtacctttcactaaaactttatctcttggatagcaaaccatatcgcaaatgacatcataaatctcatgtaccattatgacctcatcttcattatgacgttctgcaatttctataagccaactaagccttatattatctgcaattatttctttgtatttataaatatctatctctcgctccacatcctcttctacttctgattttccagatagatggatagattttatattatctgtttttatttctttgctcttattatccttattatattgcagtgttttttccgcgatggcatttccgtattggtttttccatgtcgaattatctgtaatggattcaccgtgacggatttcccgtggcggtaaatctatcacattcctcttttcagtaaaaacttctatttcgctaacatactttccatcttttccccgagtctttttacgcactacatatcccagtgattctaaattaaaaatagattttcttatagcgtctacaccatctggaacaatagcacttaagcccgatatgctaaatttccattcatctggcaaactgcatattgtacataaaactcctctatctttcatagaaagctctttatctctcaaaacattattactaattattgtaaaatttttttgagttttattttttaaaactgccattcaaaaactccttatctaagatttttcttgaaaagaagcacctgccatgctaacatttactcagcacattcatgttagtaataacatgtgcagcccctttgccgaggggctttttcttttctaattatttctgtctttcttattaatgaacaccagatttcaaacacgcctcctcataccagattcgattaacctttcctgatactacaatcgctcttggattctgttctttcatttccttattcagttgctttatcacctcataggctttggctctagatactccaagatcaaatttgactgtatcgactcctacaaacattggtactctttcttctgtcataactttctcctttcttgaatttaataatcaaccttaaaggtttgtacattcataatatactaatctaatcagttaagtcaagtcttaatttttttagttaatccaatttttttagtttaatatttttcatttcttgttataataagattaaactatttttgaaaggttgattttatgacttttgatattatgaaattatttgaaaatgataactttatctctcctggttcaatcggcggaaaaataaaaaaaattcgtgagttaaggggacttacccaaaaacaattaggtatcatgtgtggtttttccgcttcatccgcagatgtacgaattgctcaatatgaaaaaaacaaaaaaataccaagagagaaaacactcaaagacatatgtgaggccttgaatattgatgtgtattgcctatttgatgcagatatgctcccatatcagcgtatgtttcacgctttattcgatattgaagactttcatggtttacatcctataaaaagaaataacaaatactatcttgaattcagtggacctactgttatagggcaagatatccttcctcatgattttgacgaatttcttaaagaatggtatgagatgtaccaacaacatcttccgaatccaagcgatactaaaaaagagaaagaaaaaaaagaagctaactatgctctatggagatatgaatatccaataaatgttgctgaggaaaacacaaaaaaattacaaaatcaaatgaaaatgaatcacttacaagctcaaatggatgctttaaatgcagaaatgcaaggtgaggccgaactatcacaacttgattctgcaatggcagatgctcttgcagctagtaaaaaagtatatagggatatcacaaaagaatctgaatttattctgcttataaaaaaattaatagaagcagatattcctataaagcgtttttcacccgaagtcagcactaaaattgactatgatcacatgcacattatctctattaaaacacaggatataattaataatgaatctaacaagtcatatttcgctgaattcctatgtcaaattgaaactatgcaaagagccggtttgaatatcaacagaaaaattacttgcaaaaataatgaattgtatgtaacttatgaaatagccagctcacaatggaaatatcttgaaaacctaaacagatactgggatgatattatctatattaaagagcgaattggttcatggccaaatcaagaaatagacgaattaaataagaaatttttaaataagattactggccctcatgacatgataattaactaatattactttttcacacaaaactactggaataatatagacattttatagacgaacaaaataaagagccgctatctaagcggctcttcggcattttggtactattcaaactctatcgttcctggcggtttgctcgtcagatcatagaatactctgtttacgcctttgacttcgttgatgattcggttcataactttattaaggacttcgtatggtaactcagcggattctgcagtcatgaagtcgattgtctttacggcgcggagtgctactgcgtagtcgtaggttctctcgtcgcccattacgccaacggagcgcatgtttgtgagtgctgcaaagtactgattgatttcctggtcgagacctgcattcgcgatttcttcgcggtagatggcatcggcatcctgaacaatctgtactttttctgcggttacttcgccaatgattcggattccgagtcctggacctgggaaaggctggcggaatactaacttttcagggattccgagttctaggccggcttttcgtacttcgtctttgaagaggtcgcggagtggttcgatgatttctttgaaatcaacgtagtcagggagtcctcctacattgtggtgggacttgattactgcggattcaccgccaaggccgctttctacaacgtctgggtaaatggttccctgtgcgaggaagtctactgcaccaatcttcttagcttcttcttcgaaaatacggatgaattcttctccgattatcttacgttttgcttctggttccgttacgcctgctaacttatcgtagtatctctgctgtgcattaacacgaatgaagtttaagtcgaactgtccttctggaccgaatacgctttctacttcgtcgccttcgtctttacggagaagaccatggtctacgaatacacaggttaactgcttgccgatggctttggataataatccggctgctacggaggagtctactccgccggagagagcgagtaatactcgtccatcgcctactttttcacgaatttcttttacggtgttctctacaaaggcatccatcttccagtcgcctgcgcatccgcatacgtttaatacgaagttggataacatcttcgttccttctactgtatgaagtacttccggatgatactggattgcgtataagcctttatctgcgttctctgcggctgctaccggacagtccgctgtatgggcgctgatggtaaatcccggagctactttggaaatatagtcaaagtgactcatccagcagattgtcttttctgatacatctgcaaagattttagaatctttcttatctacgaatacttccgtttttccgtactcacgtaccggcgctgcttctactttaccgccaaggatatgcatcataagctgtgcgccgtagcataaaccgagtacagggattcccagttcaaaaagttcttttgtataggttggggaatctgcctcgtagcaactgtttggtccacctgttaagatgattccctttgggttcattgctttgattgtttcaatgtttgttttataagaataaatctcacagtatacgttacattcgcgaacgcggcgtgcaacaagctgattatactgtccaccgaaatctattactataacggtttctcttttcaaagatgttcctcctgtcttttatcattctgtactttattctataacattttccgtttgctttctacccctaatagaaaaaaattttttcttttgctcagataacaggagtccaccgagtactaacaggattcccaagccggataaaaatgttattttttcatgtagaataatgacggatgttaccgctgttactaccggagcgaggtagatatatacgcttgttttgattgctccaagtattcttactgccatgttccatgtgacaaagcagatggcggatgctccaagtcccagatagaaaatgttgaataggtatgccggtgtggcgaaacgggtcagatcccatttaaaatcaaatataaataatgccgggatcataaatagtattccatagaaaaaggttcttcttgttgcctgaactacagcataaccaaagcttcctatttttttggaaagtacggaatagaatgaccagattatcgctccaccaacagaaagaaggtcgccgatcggatttaggtgcatcgttgttccgctaaaactaatcagggaaattccaatgagggcaatcacacaccccatgaaaaatgctggtcgaagttttccttcttcttttaagaaaatgcgtgctgttattgccgtaaatactggcgcaatcgaaacgataacgccaacatttgatgcctgtgaataggtcagtgcgatattttccattaaatagtacaaggtcattccggtaagccctgcccctgcaaaagtcagctcctgcttccagcttttaaatggcaggcggtgcggattcataatccacaataaaaatcgtaaaaatggcaagaacatgaccaaatgcttttttattttccatattttcctcctctttagtttttataatcttctctcattttaaatacactctcaccattgtatctcaaacttgcaaaaaagtcatgggcgaaaaaatatttttattttgtattgacattttctcgtcctgcatgtattattgtattaatcacttagtacaataatacagaattttattgtaaggaatttattacattttcctgcaaaatagaattgtatcagatgtgagatgacgcgcagcttgcagcaaaaatgccgaggcattcttgaatgtaagtgttgataacttaaaggaggtgttataaatgtcttggaatcttgactccagccgtccaatttacgctcagattgtcgagaaagtatcgctggatattgtatcaggcaaatatcagccgggcgacaaacttccttcggtcagagatttagctgctcaggcgggggtaaatcccaacacaatgcagaaagctctttccgaattagaaagagagaacctggttcattccgcaagaacaagcgggcgatttattacagaggacaaagctatgattgaaaaaatgagagaggaactggcatccacacaaatcaaagaatttcttaataaaatgtcacagatgggatttgattacgaaaagacaatcactttacttgaaaaactcggaaaggagaatcaaaaatgagtacgattctggaatgtaaaaatctatccaaaaaatatggacgcaaacaggcactcgacaatattactctttccttagaatccggtaaaattatcggtcttctcgggccaaatggcagtggaaagactactttaatcaagttaatcaacggattcttgctccaacaggcggaaaactttttatcaatggaaatacccctggagtcgaatcgaaaaaaatcgtctcctatctcccagagcgtacctacttagatgaaacacagaaagtttcagaagcaattacattatttgaggacttttatgaagacttcgacagaagccgggcaatttccatgttagaaaagttaaacattgattcaaatgcccgaatcaaaaccctttcgaaaggaacaaaagaaaaagtacagctaatccttgtcatgagccgccgcgctaaactttactgtctcgatgagccgattgccggagtggatcccgctgcaagagattatattttaagtacgattatcaacaattacgaacccgattccaccatcctcatctccacacatcttatttctgacgtggaaaatattttggatgaagttgtttttatcaaaaacggacatatcgtcctgaaaaatgatgtggaagatattcgttttaatcagggaaaatcagtagatgtattattccgggaggtattcaaatgttaggaaaattatttaaatatgaatggcgttctatttcaaagcttctactgccaattcatggattcgtgttattatttgctctcttatcccgcttttattttacaataagcggaggaacagacgctttattaaacaccgattccactatcataggtacattgacaatgcttcttatttttgctcttgttattgtcatttcaagtattgctatctttacttatatatatagcggctatcatttttataaaaatgtatttaccgaccagggctaccttacaaataccctgcctgtaacaccatcacagctcttactttcaaaagaacttgctgctttactatggcttcttattgacgttgtagttatcagcatatctatctttattttggtaggaagtacagagcttttctctaactttagtattttctggcgcactctgatgcgctatgcaagccagacaccgctctttacaacattagttattatcgcccttgttctagcaccattcctgctaattgatatactgtttttcagtatcacacttggaaaccttgcctccagccacaaagtacttgcttccattggggcatatgttggaatttatgttgttcagcagatatttggattaatccagcttgtagtctggggatacttcggcagcactacaattatgcgggtgaatatttacagcaataactacttctttaaaactttccttaatccaattctgattacaggacttatctttaatattattctgattgccgtatgctggatgggaagtaaatacatcatgacgaagagactgaatcttcaatagaaaaattctgatttgtgaggttacggagcagacgaactcctgaaagtctccctcaaatctttctcaaaacaatttctgagtttgcataggcagccaaagacagctcccaaagagagagcataccttatatttgtggcctcggagcaagatttggatacgagcgtgtataagcgagtattcaaaccgccgcgactaaagtcacaaatataaggtatggtctctctttgggagcgtctcttttgcctgcggcaatcagaaatcgacctatagaattacatattccttatattttttgaggtctttaagcagacagctcatcgttattttcgttccctctgcctcatattccgtttcttttacagttgcattttcattgaaataagacaccaatgccccttccgtatacggaatcagcatcgtacattctacataatcctgataaatatggttagaaataagctgtacgagttcttctaaaccaatattctgtccggctgccatatagatgcagtcttttccgatatgtggaagctctgctggaacatcttctctcccatttgccttcgcaatatcgcatttattaaagacatgaatacatggaatctcatctgcgccaagttcttttaatgtctcacgagtaacttccatatgctccatataatgttcatcagaataatccacaacttctaataacagattggcatatttcacttcttctaatgtcgaatgaaatgcttctaccagattatgtggaagcttactgataaatcctaccgtatcagagagaaggaactctctcttgtccggcagatgaatcttacggactgtcgtatccaaggtggcaaaaagcatatttttcgccataacttttctatcttcctttttctcctcattttcttcatatttatcgataaatgcatttaaaagggttgactttcccgcattcgtatatccgactaaagcaacctgggggattccctgtaccagacgacgctttctttgcgtttctctgttcttctctacctcacgcagttcctttttcagttcactgattcgatgacgaatctttcttttatctaattccagcttcttctctccggcacctttattagaaagtccaccgcttccgccaccctgacggctcaatatctcgcccattccggtaagtctcggcagctcatactgaagtcttgccgtctctacctgaatctgcgcttctctcgttcttgctcgtgaagagaaaatctgcaagatcaaatgggtacggtcaaacacaggccgttcaataatatcttttaaattacgaagctgcattggagataaggtattatcaaaaatgacaacatccgcttccaacatatggacaactgccttaatctcctctacacgccctgtacctacatatacacctgtattaatctggctgacattctgtgtctccaccccaacaacttccatgtcgcaggcttccgccagactttctaactcctttaatgctgtttcaaactccggatcattatttaaattcacaccgacaagcagtgcctttgttctttcttccaaatagatacccctttcatggtaaaatgtctctcttgcaaaataagtgaccagcttctgagttgtataatacctgtatcgcccccactcgtcaactattaaaatactaagttgtagatttaggatagacgaaaaaagaaatactaccatatcccatctgctctatagtcgctgtgtttaaaatgctcgttcgcatcttaaacacgctccgaagccgcatctgggatatggtagtatttcttttttctgattatctaaataagggggattacccagaaagctatgattgtaaaacagagatggtatattatagggaatatgatatagtataattacagaattttcatataggaaacttgggctgacatgaaggatgctataaagaactgagaaagtgtatcagagaggaagataaaaaaagatgaattttacaacattatgctatatagaaaaagaaaataaatatcttatgcttcatcgaacatcaaaaaagaaagatggtaataaagataaatggattggagtagggggacattttgaaaaaggagaaagtccagaagaatgtcttttacgggaagtaaaagaggaaacaggattagagcttacatcctatcaatttcgaggaatcgttacttttatatcggatgagtggccggatgaatatatgtgtctatatacagcagatagatatatgggaggcatcggaaactgcgatgagggggaacttgtctgggtggaaaaagaaaaaattatggatttaaacatatgggaaggtgataagatctttttaaagcttctgatggaaaatcaaccatttttttcattaaaattagaatataaaggagataaactagtaaacacattcttaaataaatactaagttgctggggacacagacgccgctttagtagaagatattgagctgaattgtagttagtcttgtaaagaaaaaagaatagttataagtttgattttgttccgttgcgctaagcattccattctgcccagaaaaacaggaacttgggaaaaacgagtcccaagttcctatggtcagaattccatagcgcaaagtcacaaaacgcaatacttataaccattcttttttctttatcgtagttctcttacaattcagcataaaattttgttttagcggctggctgttcttaataaggaattagtattttagtctgagggaaaaagaggggattgtccagaagtctatggtttcactagaataaaaatctccagaggagaatattttctcatggtgaaacagttctccgattaaaaatcatagccttctggcacattccatgttgttaaaccgtagatttagatagtcagaaaaaagaaataataccatatcccagatgcggcttcggagcgtgtttaagatgcgaatgagcattttaaacacagcgactacagagcagatgggatatggta

SEQ ID NO: 452 - DNA, 17980 bp, Eubacterium hallii
atgaagacgtacaatcttctttttgaattctggttcatagtgtttactcatttgtaacatacctcgtttcctcctaagattatatcttattaggtcgaggtgttacaactatgttatatcacaacatctaaagaacaaagaattgttataagtttgattttgcttggttgcgctaaatgcttcattttgcctcaaaaaacgaagggctgtcggttagttaataccaatttttaagctctaaatcttaaaatacgaatctgccgattcaatattcctttctcactctatatatttgtatgggcttcctcttttaaagcttcccattgttcattgatcttcatgaccttatttttctctacatctttttcagcatcatatttatagagacatcttgctttgtatctgcagccgttgcaataaccactgtctgcagttacttcttacaaaatctcttcaaatgcgtttttgtgcttttctaacacagggatcaatgtatcataatctgtccagtcaagtatagcggttcacattttcacataactccacaatacggtcaacagctcttaccccacgcatatttgcgtaagtaacgacagcatacatcatacttgggttaaacctagttcttcccttatctgaacagttggctaacaagccagaaaaatccaaatcctccatcacttttttataacatggaacggggaaaagatggttgtcgttagccatctttttcctttttatagaaaaatcttaccgaattatagctatttcaatcctcgactccgaaaaggaggcgacaacaatagcctttgcggtttgatgaatatcggaatttcaatccacgcctccaagaaggaggcgacactctccactgtcagtaccgcttgagactaattatttcaatccacgcctccgagaaggaggcgactgcaacatattgtgatacctcagctatcatgtacatatctagtctcaacaacttttttgttcgctatttttagctttatatcgcaatatgttatactatttttccttttttaagtgcgaatggcctgcgttttttgcgtagcttatgattcgcgctatgtttaatttttaatattttctatattttatttcaaggtattccttttaacgaagataagataataagaaactttttctttctacatttgactatatctaaatttagaaagattttcgaaaaagggattttggacaatcctcattctcaccaactgtagatttcgattagccagaaagaagaaatactaccctatcccagatgcggcttcggagcgtgtttaggatgcggatgagcattttaaacacagcgattacagagcagatgggatagggtagtatttcttttttcgtctacaccaaatctacaaatccgtatcgtgtttaggatgcggatgagcattttaaacacagcgactgcagagcagatgggatagggtagtttttcttttttcgtctacaccaaatctacaaatccgtatcgtctatatcgatttcttttggttgtttacgatagaggatatcatacattaccggaatgataaacaatgtcataagcgttgcatataaaaggccgaatgcgactacaacagccattcctttctgcattgcatttccggcatcctgtgaaaataccataacgctcatagaaagtattgttgtcagtgcggtcatgaggattggtcgcatccttgtttttcctgtttcgatcagtgcttctttttttgccatgccgcccatccgcagctgattgacgtagtctacaaatacaataccgttatttacgacggttcccatcaggatcatgaaacccattaatgccattgatgaaatggacaaatggaaaattccaagaccgatcattccgcctgtaaatgccagtggtacggtaaatataacaataaacggagataagaggctctggaactgtgctaccatgataaggtagatgagcaaaaagccgagtgctaatgcttttcccatctgttttaacatttctgtggtctgtgttgcatctccggcaagttctacttcgtaaccatccggtgctttatatttatcaatcttttcttgaagttttcttgataacaaggtggcattggcattgtcttctaattctgctgttaccgtcagatacggcttttgattttctctggtgatactttccatgctgtatccatcgtcttctgatgcaaattcagacagtttatatgtatgtttttcatcttcgccatcactatttttttctgtggtttcgattttcatatctaaaatgttttcataggtgagtttgtctgtctcattgatcagatttacttccacatctttatcatccatatttaaggtaatcgcatttttttcggttgttgtatgttttgcgatttcctgataaatctgtgctatcgtaagaccatgttctgctgctttatttcgattaatttttaaatgtaacatcttatcggcagtttcgataccatttgttgctgtttttactccagagatatttttcatcatctttacaacatcttcgctgatcttaattaatttctgctgattttctccgtatacattgacagaaagccccccaccgctaagagtggacatatcacctattgcagaggaagataccgtaagttttttacatcgtacattctttgtcttattctcgatatcttttcggattttacggaattccttggttgttttaatattttcttctgtaataatattaaaagtaaatgttgtataattatctgttgctccggtttccatcatacttgaagttacactggcattgccatcaagacctgccaccttcttaattctgtctattcctgtcagtattcccattacttcatcggctgtctggtatgccttttctttcttgatcgtatcttctaatgtcatgctgactgcaatctggttactgtccatatcatccatcataacaattcctgtccgcatactctgcatcacacaaatgatgagcaatacaatagagataagcagcggaacgattttaaatcgaagtgcaagttctaaaatgtttccataaacgtcctttattttctcaaaccatggctgttttatctcttttgcttttcgaagaattaccgaacccattgtcgggacaacggtaagagccacaagcaaagaggcaatcagtgcatacgatatcgtaaatgcaaatggaatcaataactgacttaccataccggatgtgtaaaccatcgggagaaatacacagattgttgtaagtgtggaagctaagattggccccgctacctgtgctgttccccgaactgctgcctttggtgctgacatgccttcattgctgaatcgatatacattttccataactacaatagagttgtctacaagcataccgataccaagacaaagtccagccagagacataacattaatattgattccggtaaagtacatgataataatcgcaaataatacactaaacggaatactaaacgcaacaatgatcgtcggacgtatatcttttaagaagagggcaaggacgatgattgcgagtaccgcacctaataaaatactattcaatacactctttataatgatattgatatactctccctgattcattatgattgcaaaagaaagacctttatatttctgttccagttttttaaatgcattctgaattcctttggatacagtacttgtattcgatgtacttcctttaaatacagataacagaatggcattctctccatttacttttgaataagcttcgccctgattatctacaacggtcacatctgcaacgtctttcacccgaatctttcctactccatcaatcttcgtaagtacaagattattcagctgcttttcatttgtgaaattatctccgacttctacaagccactgatgatcactcttgtcttcgatatatcctgcaggcattgaaaaattctgtgctgaaatcattgttgataaagtatcgagactcaacaatgcatcaatatttgcgttctctctggcagcctttctggaatcttctagcttatcctctgcatcgtctaattccttctgcgctgattctatctgcgtttttccggctgcgatctgtgcctgaccggcaccaaatccggctgctgcagaatagccgcctgcaattaattttgactgctgcttatcaagccctttcatctgctcttttaacttatcaataatcgtcttttgtactttaatctttatttttaaattagaaagttctgtatcaatctgcggaagacgaacttccactgctttatacatttgcttcaaagaatctatcgtcagtttagaaaactgttcaccataccctatctgctccatccaggagacaaacgcttcaaactgctttggatgattcactgcttctttcactgattccggaattgtaattcccatctgttttgctgcttcacccattgtcacattcaagtttttgaatgtattattcaaggtatggtatgttttctcaagacccgcttctttatatgcctttttttctgcctttaatgcactctggctcgccttcagactattaagttctgcttcgtatgctgctttctgtgataatgcctcagcaagctttgtctgcgcctcagcaagcttctgattcgtttcttgctgcttgccgcttaacgtcttttcctgcttttttaactgttctttactcttttttagagaagcccttgcatcttcaatcttctcacttgcctcaagaagcttgtcattcgtctgtccgagaatcttatcattcatccggtcaatcttcttctcattcagacgaatctctacatgatcttcaataagaccgttagctgatacacttgccacaccatcctgacgttctaaatatggcttgatcgtcttttctgcaaaattagacagctctttaatatccttcccttcataactgacactggcatacattgtcgccatcatatccgcactgatttccatgatattcggtgttccacacccctccggcagactcagcgaattcaatgccttagacacacgaacaagcgccgcttccatgttggtatcttccgcaaattcaagcatcagcatcccataattattggcagaagtacttgtcagtttctctacgccattaatcgtaccaagcgtactctccatcggcttaataacatcattctccaccttttccggagaagctcctacttctgttgtaatcaccgccatgtacggcagttctaactctggaagaagatctgtctgcatctcaccaagactgacaaaaccaacaaccaaaacaatgattaccgtcaccagaacaaaatacggtttctttacaaaaaacttcgtcatatcctttcctcaaactttccttttactcttttttactctttcttattcattcttactcttttattccctaaaaacatctactctctgtaactgttcccttccatcaaagtatttcatcaaactcagacagtattgtataaattgtatcatgaactcctgatttttttcaatagaggaaagagcggaaatcctcttgcattaaatcattattctgctatcataggattacgagagtagctaaatcatgatactattcttgaatttcaggaggttcaaaagacattatgatacaggatatttacccacataaattagataaccattttgatattgatgcaaagccggataatgacagcatcgttttatatttcactaaagaagggattcttcataaactctcttcttataaagattacgaaaattatctctttttcccgaccgttcaggattttataacaaaagacggtacatttccttttgaaaaagatgcccttacttatcttttttctgtcgatgatgctcattactttttattagaacaggaacctgcacaacttccaaaaggctttacctttaccccgattcgtaatcttcgcaaaaaaaatgttcacccaaagcactgtatttttgcgggcatcacaggctttcagcttagtaactggtataaaaataatcgtttttgcggatgctgcggaaataaaactgtccactctactacagaacgagctttaatgtgtccttcttgcggacatgttatttatcctcgaatcgtgcctgctgttattgtcggcatatgtaatgatgataaaattcttgtcacaaagtatcgtacaggttttgcccactacgcacttgttgctggcttcactgaaattggagaaactttggaagagactgtacaaagagaagtacttgaagaaaccggactgcgggtaaaaaacatccgttattataaatcgcagccatggggaatcgttgatgatatccttgccggtttctattgtgatgtggatggagaaactgatattcatatggatgaatctgaattaaaactggcagaatggaagaccagagaagagcttgaactccaaccggatgattttagtctcacaaatgaaatgatgcttatgtttaaaaatggaagaatgtaaaagggtatatacaaaaagaaggatgctgtatgatatgcttccttctttttattataaattattcattatttcaatccactgctgccattaatttacttaccttaatttattaaaacaacagttgaagtcccattgcaatgatccacatatacgcacaggtctttggaatcatcagtaatccaacttttggttttgttttgctaaataatgttacaggaaggtaacagccaaaggaaataataatcgctgcgaccattcttgtcatatggtatccatttgcatttccggatatcgcatacagaataatgactcctataccagtaacagcaaaaacagcattcctgataatcgataacttgagatttccatcctctgtacaccagttattctgtggaagaagacagacagcaattctaatgatcgcagaaatccataccattgctttcactgcagcaggtatattaaaatccgggaaagtatccttccaaacatacattaaaataatataaaatacagtcattgtgattgaggatatctgtaatccaatcccaagctgtttctttattctgtcattcgttccacgtgcagctcttatgattctaggtactaaatgaaatgcatctccgccgccaagagtcaatgttaatattccataaagaataaacaacgtatttccttttgcataggtgaaaaataaaattgctgctactaaatcaaatatcaaatatccggcatcaaatatcgcttccataatatccggcatctttggctggtatttttcttctctcattcttacttctcctttttaattaattggttataacaaaaatgatttttcattctcttcctccgcatatttttttaagtacgcatctgcattggcacaaatcttattaaatactgccatgcacatatacttttcttctttggttaatccatctaaagcattcttagcgaattctttctgtgctttcattccatctttgataatggactctgccttatttaatataacaatctcaatatgctttttattcctggtgctctgaattctttcaatcaagcctttattctctaatgctttcagagaagtagatacgtgagatttcgttgatttacgaatctttacgatatctgctgctgtattatacttcggattattatgtaaaaacataagtatatcatattccatttgcgttagctgatacctgtcacatacttttctcgtaaatagttcataacagctggtgattgttttatgctgatcccaaaaaaacatatttctactccttgttatatcgctttattaatgttctatttagaacgattatgattatatagttctacttcctttttgtcaagctttgatttttttacgcaaatggctgtcgggctattgttccgagataaattcaagtcgagtcgctgcgagacttggcgcgtgattctggtcagcgtaagctgacatattctttacagaatcactgcgcatcctcgcggagcgtttatctcagtcggagattggactcccactgagacaaatttgctgtcactcaccacctgaaagaggtgggagtcttctcgactgagataaaaataaaacatagagagactccatatataaatctgcactatttgaagaacgaggagagattgcatccaagggaagaagacaatctcttgtcttactgacctggacacaatccgacgaagtacttcaacgagtgtggatttatatatggagtctctctgtgtttttcaatagtctaaagttggaacaatagcgcgacagcccctcgcaatctattctttattaacaattaatggcagctgtgatttccacatccatgctcaccacaggtatgtccttctccatgttcatgatcatgatgactgcactttacatcagggttgtaatctaacgttccgctcacaaaagcttccacagccgcatctgcatcaccggaaacgcctccataaagcttaattcctgccgctgataaagccatctgcgctcctcctccgattccaccacaaatcagaacatccgcttttaatgcattcagaacaccagctaatgcgccatgtccgcttccattcgtatctacaacttcagaatggattacttttccatcctctacatcataaactttaaattctgctgtatgtccaaaatgctgaaaaatctgtccattctcatatgttactgctactctcattataccttctcctttttctgttgcatacttttgataaaattcttgtttgtagcatccacccagaccacatttactacttttaccatcgcagatccggaaatctcctccttcaattcgaagaggatgtccatctatgattgcatctgccactttttttctggcgatctcatagattctctgaacagtcgttcttgcaatctgcataaagcctgcacactgttcctggctgtatccttctttatctataagacgaatcgtttcatattcatctactgtcagaagaatcacctctttttcatcttcctcccctcttcctccattttcattggatggtcgaaattccaatatatctggaaaatggcagacttttctgcactttatcggtcttggcataggatactcctttcacaatcttttctctatactacaaccattatgagcatatgtcaataacttaattgacatatgctcatttcgctcgtcttataaaatcagaagcattgtcctgtaaattgtttttaaaacagtcatttaaataaataatatgcgataccgctataatcacgctacgaagcatctttttttcaaatgaactatctcctgtttccttttttggttcttctttatcttcaaatatagctacaagcgtcttttctaattctgaacaaaaataatcataagcaaccggtaacgtataggttgctttttgtaaaacgaaaagggatgctatattatccatggaaagaacctgctttataatcacaatataaatcgcatatgctatttgatctgcatagtactgcttttttaccggccggtcaatatatcccttctttacataattacttaacatggatggtgtaatcgaaatttctattggtgctaaacattcattaatgtactttactgtctgctcaagataaagtcctacattgggaatttctttatatcttggcattctatagtctctggctgaaaatttcataatatattccttctttctgactttgtctctaacttgatgtcacgaattactccgtagctaacgctactcccgtaatttgttattatataccagctataaaaaaaccgcaataaagttatttaataccttgacaaacacatgtgtatggtttactatactttttgataagtttttcaaaaaccgatatgatagtatttaaaactattaacggaggttacatatgaaaatgaaaattgttgcagattcatctgcaaatcttttagctttacctgatatagatttcgggattgtcccacttcatgtaatcgtaggggagaacgattacgtagatgatgataagattaatcttacagctatgcaggaggatctttcttcttataaagggaagacatcgacatcaagtccaagtcctcacgaatgggagaatgcgtttggcgatgctgatgttgtcttttgtatcaccattacaagtactctgtccggtacatataacagtgctgttatcgctaaggacatttatgaacagaatcatgccggcaggaaagtatatgttttagattctttatctacaggaccggaaatcgcactttttattgaaaaaatagcagaactcataaaagctggttttgctccggatgatatttataaaacccttctcgaatataaagataaaacacacctgtatttttctctggcatctttaaacaattttgcaaagaacggacgaataagcccggtaattgcagccggaatcggtttattaggagtcagagtcgttggaaaggcgagtgatgaaggaactttattaccgcttgataaatgcagaggagaaaaaagagcattaaaaaaactgatcgatcatcttaaagagtgtggttatacagatggaaaaatcatcattgctcacaacaataacgaagctggtgctttagaattaaaaaaattgattgaaaatacatttggaatttttaatgggaagattcaaaaaacaagagccctttgcagttattacgcagagccgggctcccttctcatcggttttgaagcataggaaaacaagtctgtatggatatatagaaggggctattgagaaataaattgttccaaacaggggaagatttgattcatgtgagtcaaattttcccctaaaatttttcctaatgcagtgctttgtttgggcaaactttcaggcatttgccgcaatggatgcatttattttcatcttttgtatagtaattatggctctatctggttttatatgtgttccactgttcaaggtccacagactatactgaatggtgttatcaatttgttatcatgattgtgtatcaatcgaagattctcgtaatatcctgatatcggttaatcacacgataaatctctacatcctcttttcttactttatagataatcacataatcttcccatattgcatatttataatctgtccgaaagctgactcgttttgaaaggtccgaacccattcccggaaacatttgaagattttcaaatttaccgtaaatttcctttatagtctttgcggcatattcttcgttatcctcagcaatataatcccgaatattcttaagatcctttgcaacaataggattaatccgcagttttaacattttattcccccacaagtgctttcagttcgtccaaatccagccaaccttcgccatcttttactgcttcttcggcttcctgcaacttcagcagaagctttttctctgcacgatcacgctcgtaatcttcaatatccataactacaaaacgtcctctgccattctttgtcaagtatactggttctcctttatgacagtttttcaaaacttcattatagtttctcaaatcagatactggtaaaatatttgccatattctttcagctccttccttgataaaacgaacactcgcattcgcttctcgctcataaatacaacctactgtgcggtccacattcatattgtttctgttacttttattatacacaaaaagctgtaaaattcaacgtagatttttacagctttacaagaatttcaatattttatatcacgctctaatctggatagtttttatttctgtttaccagccgcccaatacttgactgatctgggcggaaaagcattgttgttttctgtgaaaatgacacatcatgttttgatgcctgacacgctgcataagccagcttcatgatatgcgtttttcccatagcattttcgacatatgtcctttataaatcacctaatagtattacttattttcattattttttaatttacatataccctgcgtcattgttcccattggacaaaatgtacaccaagttcgaggcttatataacaccattacaatcaagcctaacaacaaagatgtaagcatcaaactataaaatccaaaactaaactgtgccacccaatcagctattgttcctgcagtgtatgcccatccccatggaacacggaaggtccagaatagtttgatagcttcacgcaaggaggatgctccggcaccaactaaatatgtctgaaataccatatttccaaacattgtaaggaaaaatatcaaaaagccatatcggaaccattttgaactcatccatcgtggggttggtttagttcttgagcattttaaatctccaccaagcttactaaaaagctggccacgtccacacaaatgattacagaaaaatttatttccaccgaatattgctattcctaacggcaacagaaaatcaatcatgccaaaccaggcgaacaatatattaaaaaaaccgagagcaaaataaaggattgcccatatccataaatactcataccaatgtttctttttcttcacaccgctgccctctctttcatttcaatgcatcctaccggacaggaccttgcacatttcccacatcctacacacaatgtttcttctactaccgcataacacccacgatgcactttaaccgctgccagcggacaagtattttcacatactccgcaggcaacacatctttttttatcgacacttgccactctttttgccaatgctttgttcccctttcaaatttggtaccgttcttgtacctaaaaaaggaaaatccttctgtgatattattacatagccaatgccagtgcagactgccatcatctaatagtcagtatatttttatttatggcatatgtcaattatgtaattgacgcatcttaaaaaagaaagtatactaggttcgtaaaggagataaccattatgaaattcgaaaattattttccactatggaatgacttaaatacagcacagaaaaaactaatttcagacaatttgattacacgggatgtaaaaaaaggaacgattattcacaacggaaacctggattgtactggattattactggttaaatccgggcagcttcgaacttacatactttcagatgaaggacgggagattacactttaccgtttgttcgatatggatatgtgtcttttatccgcctcatgtatcatacgctccattcaatttgaagtaaccattgaagcagaaaaggatactgatctttggatcatccctgctgaaatctataagaacatcatgaaggaatcggctcccgtcgcaaactataccaatgagttaatggctacccgtttttctgatgtcatgtggctgattgaacagatcatgtggaagagtttggataagcgagttgcttcatttcttttagaagagacctctatcgaaggaacaaatgaattaaaaattactcacgaaactatcgccaaccatcttggttcccacagggaagttatcactcgaatgcttcgatactttcaaggcgaaggtctcgtcaaactctcacgcggcaaaatcaccatccttgattcgaaaaaactggaaacactacaaagatcataaacctgtttttctataacatctaaagaatcctccatttatcagaattatgaaaatcattctaataaatggggaaattcttttatactacggtcaaactataaaaatattttgtttatttctaataatccataccacatacatatgacctttcgatcagcgcacggtcattaaccactgcgtcatagaagcggaatccaccggaaaagttgtatgtttcataaccgtttccttccagaatacggctcgcaatataactgcgcagaccactctggcatatcagatacacaggcttttccttctcaacttcattgattcgttctcgcagttcatctacaggaatgtttttgaatccatcaatatgccccctgttaaattcacctaccgttctcacatccagcaacacaacacttttatctttcgaaatcttatccatatctttcagatgccattgttttaaggtaccttttgctatattgtctatcatgaatcctgccatatttacaggatccttagcagaggagtatggcggtgcatatgcaagatccagatctttcagctgggttgccttcagtcctgcatggattactgttgccagcacatcgatacgtttatcaactccttcatatccaataatctgagcaccaagcaaacgataagtctctttttcaaaaaccaccttcatggtcatcacttttccaccaggatagtaaccggcatgactcataggagaaagaattactgtatctatatctaatcctgactttttggcatttgtttcattgatacctgtagtggctgctgtcatatcaaacactttgataacggagcttccctgactgcccaagtaatgactatcaccaccacaaatattatcagcaatgatccttccctgtttattggcaggtcccgctaaagagattaacgcatcattgccagtaacataatgttttacctgaactgcatcacctgcagcataaatgtctggtacagaagtttccattctgtcattcactacaatactttccttgatgccaagttccagacccgcttcttttgctaatgctgtgtctggtgtaacgccgattgccagtactaccatatcagcctgaagggatggattatctttcaatagaacctccactccattgtctttttctttaaatccttctactgtatagcctaataccagttttatcccgtgttttctcatttcactatgaatcatcgatgccatatccggatcaaaaggattcatcagctgcttaggccgctggacaattgtaacatccatgcctagctccctcaaattttctgccagttccagaccaataaagccaccacctgccaatacaaccgattttggatgattcttatttatatatttctttatccgaaaagtatcttctactgtacgaagtgtaaaaagcttatcaatacctactccaggaagtctcggctgtgttggctttgcacctggagagagaatcaacttatcatagttttcttcaaatatctcaccgttttccaaatttttcactgaaacagttttacaagccggatgtatggagatcacttcatgatgaattttcatattgatgtggaagcgtttaaaaaagctctctggtgtctgtaatgtaagttcttctggatctgtgatcacatctccaatataatatggaagcccacaattcgcataggatatgtatccgaatctttcaaacacagtaatttctgcatgttcatccaatcttcgtattcttgctgcagctgtagctcctccggctacaccgcctacgattattaccttcatcttattttttcacctttcctcattgaagcatttctaaaattgcattcttaggtctcacacctgaaacctgttgtacaatcttcccattcttcataaccaccaaagttgggatactcataataccaaatttacttgccagttcaggctgctcatccacattgatctttccaactttaatatcagggcgttcacttgcaatctcctctatgataggaaccaccatacgacaaggagcacaccaaggagcccaaaagtctaaaagaacggttttctcggaatccattatttcattctgaaaattatttttattgatattaatagcagacattttacagtcctcctttttttcttttatggctttattataatctgaaattcatttgttttctgtgatatcatcacattattatcatgatttattttttaagaatttattttttcatcttatgatccgatggcaatctcacttctccggtcctttttttcataattaaaaaggaagctttttcaaatctgcaacctgtttttgggtataaaaaaaggccatgcccttccgggcacagcctgatgccttaaaatttgagaaaagaaaaacctccgcaaacattacgtctgcgaaggtcgttttcttgtgatccataaaaatgtacaggtaaaaataattccctttacaattgaggttgaagaaatagcccaccatattccatccagacccataatacctccaagaatgatcgacagcggaattcttgcactggtaaaagctatactgatgatactgcaaagtcgggttctgccgagccctgataatgcaccgactgtcgtcagttccacacacataaaagcttcactgaaacctatgataatcagatattcaactgatgttgcgattgctttgggttcatgaaaaaagattctggcaatcggttccggaatacatataaatacagctgagatcaacagtccccagataccaaccgtccacaaagaagccttatatccttttttgacacgatcatttttgcccgcaccatagttctgtgcgataaaggcatttaatgccgctgcaaaaccatctgcagtattccatgatatcgattcaatctgacctccgactctctgcgttgcaacagcttctgcaccatacccggagatcatacgtgtcagcaccatggagattgcacaatatgccattccctgtattgctgtcggaattccgatcttacagattccctgcagatattcccacgggatttttgccaaaagcctagttccttttagtacattttctttcttttgtatgacaattccgactatcatgatactcataacgatcgcctgtgctgtcactgtcgcaattgcagccccgacaacaccaagcttcggaaacatccccactccaagaatcaacacaggatccaaaaccatatttgcggccaggccgacaagattcgctataaaaggtgtctttgaatctccctgtgccgtataaagtccagtcagtgtcagcgtcataaaagaaaatacgatcagcccacaggcaatcctcgtatatgacattgccgccgcatgagcctgtgcatctgcaagctgaaaaaatcctaccatctgtctggtaaaaaacagcgaaagaattgcatatgccattcccataaatgcagcaagctgtactgccgcctgtgcaaatccgtgtgccctttctctgtctccacgtccgatacactgtgccacatgcacctgtccacccattctagccatagctgcaagtccctgcgaaagccaggtaaacatacctccaacacctacacctgcaactgccttcgaaccaagcagaccaatccaggccatgtccgttatgttgtacaaagtccccagaaacgatgacgccatgatcggaaccgcaagtttcgtcagcgtttttaaaataggaccttttgttaaatttccctccattttcattcctcatccatttttattttttattatccacaaatcctattatacatggtttaacatagattttcatcaggaattatccatatatatcaaaaatccttttgaagaaatattattctccaaaagggctttctgtctgaatctttttataatttttctccgcaggattcaatgacttttttgtaccagtaaagcatcaatctgccatccccatgcagaagtttcaagatatggattcttaatattttctcctccatttgccgcagtaatttccccttttttggtgacactgacgcagttgctagaataataactgatggaaacaaaatctactgtaccattcttgagaatttcatcatcttccggcatcgtctccagatttatttcattttcttcgaaaaatcttgtagcaaagcccggataataccctctgacatgtacatctccggcaacagaattgtcaactacccacgacctaaaggtcatgggcttgtaactgcccagtcgtactaacggcttacacctccgacctttaatccccgatagatattgctatctaaagtggcgttacatcatagggtggt

SEQ ID NO: 453 - DNA, 17852 bp, Eubacterium hallii
gagattatggatacaggtcgcatagactttccatttgatgtacaggaatggacaagggaaaataacgagtttgttttttctggacgtaataaatactgtaaaagcaggaaagaagccagtgcatggatagaggaacagcaaaaagaattaaatcttattgaggtggctgttgaaagcagcgaagattatgaagatattgcaggttcttttgtcacagcagtcgatacggaaggaaacagaaagcctgtttaccgtctgatacaaaaggggaatgacgggttagaaacgtatctttcagaaacgcttctcttttatagtgaaaaggaagcaaaaaattatattaaaagtcatgcagatgagataagagagatcagttatgatgaaatgataaactgggctgcagaaataagagaagacaggattgcagcaacagaacttcaggaagaaatcttagatacggataatatagcgattacccctgtctctgaaaacatggggcagaattatcatatttcaaaagaagaactgggaacaggaacaatccgtgaaaaatgctggaagaatatccttgcgatcgaaacggtaaaacagttagaaaaggaacaacggcaggcaacaaaagaggaacagaacatactagcagattacgttggatggggcgggatcgcagatgtctttgatgtgaagaaaccacagtggcaggaagaacgggaacgggtacagactgcccttactccagaggaataccgttctgcagaagaatccgtgttaaatgcccattatacgcagccacttatcattaaagcaatgtatcaggtattagaaaatatgggatttagccgaggaaggatattagagccttcctgtgggattgggaatttctttggtcttgttccagaagatatggatggttctactttatatggtgttgaattagaccgaatgagtgcaaagatagcaggctacctttatcctgaagcaaatatccagaatataggatttgaacgtaccaactatccagatggatactttgatgtagcaatcggaaatgtaccatttggagattaccgggtaaatgactcagtttataacagtcatggatttttaatccatgactatttttttgcaaaaactctggataaattacgtgctggtggtgttgctgcgtacatcacaacaaaaggtacaatggataaagaaagtacaaaagtcagggaatttctttttaagaaggcagaattactgggagctatccgtttgcctaatacggcatttaaaaatgccggaacgaaagtaactgcggatattttatttctgcagaaacgggaaaaagaaatagaaaatcctgaatggatcgctgttacagaagatgcacagggattccgtataaacagctattttgtacaacacccggaaatgatattgggaacaatgcaggaaatatcaggaccatatggaatggaaactacttgtgtagaaaaagagggagttcctttaggagaacggctgcgggctgctatatcacatatcacaggacatatacctgaaagagtggaagaagaacgtgccgaatttcggtacggggaagaacagccgacagatgcacccgatgcttccgaggtacggatgtacagctatgtactatctgacacgggagaggtttattataaaaatgaatctggtctggaacaaaaagagacagcgaaaacagcaaaagcacgtatcacaggtatggtcgcaataagggactgtgtccgtgaactgattcgattgcaaatggaggaaacagaggatgcagatacaaagatttctgcagagcaggcaaggctcaatgcgctttatgattcgtatactgccaaatgggggctgttaaatagtacggcaaacaaaagggctttctcggaagattcctcatatcccctgttatgttctttagagaaattagatgaagatggaaaccttgacagaaaagcggacatgttcacgaaacgtactatccgaaagagcgaaacgatcactcatgtagatactgcaaatgaagcattggcagtatcactggaggaaaacggaaaagttgaccttgcttttatgtcaggtctgtgtggaaaatctgctgaacagatcacagaagaattaacgggagttatctttaaaaatccggatacgcaggtatgggaaacggctgatgaatatctgtcgggaaatgtccgggaaaaactgcgtgtagcagagagaatatcagaaaatgataccggctataaaagtaatgtagaagcattaaagaaggtacagccaaaaaaactggatgcttccgagattgaagtccgtttgggaacgatgtggattcctctggaagtatatgaccagttcatgagagaaactttccagccaccacaatatattaaagatataatcaagctgcagtattccaaatatacaggagaatggaatatcgaaggaaaaaacacggacagaagtattttagtaacaaatacttacggaacaaaaagggcaacggcatatcgtttactggaaagttctttgaacctgaaaaatatccagatatttgatacttacacggatacagaaggaaaagaacatagagaattaaataaaaaggaaacgatattagccagccagaaacaggatatgataaaagaaaaatttaaagactggatttttcgggatagagaacggcgggaaatgctggtttctatttataacgaaaaattcaattcagtacgtccaagacagtttgatggaaggcacctggagtttcctggcatgaatccagagatcactttgaaacctcatcagaaaaatgcaatcgcccaccagctttacggcagaaataccctgctcgcccactgtgtaggagcaggtaagacgtttgaaatggctgctgctgcaatggaagcaaaacgtatcggacttgctcataaatccctgtttgtcgtgccaaaccaccttacagaacaatggggagcagaatttcttactctatatcctgctgccaatatccttgtggcaacaaaaaaagatttccgcccggaaaaccgaaaaagattctgtgcgaggattgcaacaggcgattacgatgcgattatcatcggtcattcccagtttgaaaaaatccctctttctgcagaaagacagcgtgctgttttagaaagccagattgatgagattgaaatcgctatcacactggcaaaaaaagagcagggagagaactatactatcaaacagatggtgaaaagccggaaaagtttagaagtaaggctggagaaattgaatgaaaagaaaaaagatgatgttgttacttttgaagaattaggtgtagacaggctgtttgtagatgaatcgcacggtttcaagaacctatttttgtatacaaaaatgagaaatgttgccggggttgcacaaagtgaatcccaaaaatcaatggatatgtacaataaatgccgttatatggatgaaatcacaggtggaaagggaatcacttttgcaacaggtactccagtttcaaatagtatgacagaattatatactatccaaagatacctgcagtatgaccgtctgcaggaaatggagttaggaatgtttgataactgggcatctgcatttggggagacggtaacggctctggaattatcgccagagggcagtggataccgtatgaagacccgttttgcgaacttctttaacctgccggaattgatgtctgtttttcaggaagtagcagacatacagactgccgacatgttacggctgcctgttccggaagcagaatatgaaaacatcgtactgcctgcaagtgaagaacaaaaagaaatattagaatccctgtcagaacgtgcggacagggtaagaaaccgggaagtagacccatcggaagataacatgctcaagattacgaccgatggacgtaaactggcattagaccagcgtctcataaatgatatgctcccagatacggaaaataataaagtttctgcctgtgcagaaaaatgttttgagatatggaaggaaacaaaagagcagaggtcagcacagcttatcttttgtgattcttctacacctaaaaaagatgggacgtttaatgtctatgatgccctgaaagaaaaactgatgcagaaaggagtaccagaacaggagattgcttttatccatgatgccaatacggatgtacagaaagcaaaactctttacaaaggtaggttctggacaggtacgtttcctgctcggttccacttcgaaaatgggggcaggaaccaatgtacaggacaaactcatcgctctgcatcatttagatgtgccgtggagacctgcggatatagagcagcaggaaggacgtatattaaggcagggaaatcaaaatgaaaaagtgaagatattccgttatatcacagaaaatacgtttgatgcctattcctggcagctcatcgagaataaacagaagttcattggacagatcatgacttcaaaatccccagtccgttcctgtcaggatgtggatgaagctgccttatcttatgcagaggtaaaagccctggcaacgggaaaccctaagattaaggaaaaaatggacctggatatacaggtaacgaagttaaagatgctgaaagcaaactatgaaagtaatctgttccggcttcaggatgcgattgcggtagaatacccacagcagattgcaaaatatgaggaactgaacgcagcgtatgaagcagacatagcccatttagatactgccatgaatacgcctttttccatggagatacatgggatcacttatgataatgaaaagacagcaggtgagattcttgtacaagcgtgtaccaaaatgaaaaaggaacatacagatgccgcagacatcgggacttttaagggattcaaaatgaaggtctcgtattctctttttgataatagtttttatgtaaagctgacaagagaatcctccgttactgtcgaagtaaagaaagaccctgtacgcaacatagaacgtatccttacggcattaagaaaaatgccaggacaaaaagatgttgcagaagaacggctggaaggggcaagacagcagcttgttcaggcaaaagaagaagtaaataaaccttttgaaaaggaaaatgaattacggtctgtacaggaacgtctgacgaaaataaatacagaactggatatgaaaccaaaggaagaaccgaaaaagatgattaagaaggaggaactgaaaaaatgtctgtaagattagaaaaaatgggagaatgtatcctgcgattaagagaagaacggggatatagtctggaagaattagccggactcacgttgtcatcgccggatgaattaagaaagattgagagtggtacacaacagccggacaaaatgacacttacccttttaagcaatgttttaaatgtatatcctgacagtctgcagaacggagagattcattaccgtgcttcacaatccaatctgataaatcttatgaaggaaacattaaagtatctggagggaacagaagaatataacaaagagattgaggaacatatggaaaagctgcagaaagaatatgatatacagcgagaggaaaagcaggaaaaagaaaagacggaacagccagaaaaagaagaacaggtattaccgaaaagagagccggaaaaagctgcacccagattataaataaaatgtgccgaatttcggtacggataggagatggataagatggaagataaaagcagagaagtcgtaatggcaatttctaacgcagcaaggtatatggacccattttttaaattaacagcaatggggacagtgctgttgattcagtattttgcccgcatggtaaaggaaaaaaagctcaaggtaactgaatttactgactttcagaaatttctcaaagcaacagatggaaaatatgacatcatgaacgtcccggagattccagaaggacagttatcagaagaattagatgcactgggtatccattatatggtattacccgatctggaaaaaaatgatgggatgctgcaggtagcagtctaccagccagacagggaaaattttggagcatggtatcaacggcatatcctgtcgcagatgacaggaggggaaaaagatttacagcagttaaagaatcttacttctggaaaaacaacaatcatttccttccctcttgaagaggaagaagaagtggtaaaggaagattttgaaaaaatggggataaactattcccagcttccagaccttcacgttggggatggtgagatacaggttgttgtagccaatgctgacctccctaaagtcgaatcatggtataaattatatcgggaagatttattaaaaaagggtatgatagatgtgcctgctatgaaaaaaatgtcgatggacaattatatgcagacaggacagcagacagaagcagagtatattgatacggcttcgcctgaattaaaagcagcgaatgcaaagtatgagggaaaacaaaaaggaagaatagagcaacagatagaagcagccgaacacaatgccatgagacaggaatcctcaacagcatatctgcgatatatcaatgacccatcatatatcccggtcagtattgataaaagaacactggttgaaaaatcaaatgtgataaataaggatgggctggagagatataaccagttctcgtgcaggataccaggtacatacggtaaaaatgaaaagcaactggtcattcctaatgaacaggtttttgaaaagcagaatggctcttatattgctttcctgcagaaagatgaatctccgtttgtttttgatgtgataacaaaacaggtagaccatgagatgagaaaactgacaggagaagaatttgtaaaacgctattttgataaagtagataaaactgttgaacgaaaagtgacatcattacaaaaatataaggaaaacacaaaggcgaaagatttaagtgatctaaagataaagatgccgactccgccgatcaaatcaaaataatgtgccgaatttcggtacaaagaacaggcagtgatgctatgctgcctgttcttttttatagaaaaggagaaagattttatgacacagaaaagaaaaccaccctgggggatgtttcttatcggcttagttcttgtacttcttgtttcctattatgcagcagggcttttttcgctggatggtgtgacaatgcaaaattatcaggataaattgacgtatatattgttgcaccctttccgtaactggttaaacagtaagacatcagcagtcatggggattgccctggtcgcatgggcaatgtttgtctgttattaccttacctattaccgtaattttcacccggatgcagaacatggtgttgcagaatgggcagacgttgctaagacagcaaaaaaactctatggaaaaggagaagaaccagttactttacttagtaaaaatatcaaggtgaacgcaaaagccttaccaaatatgcacatccttatcttaggaggctccggcgatggaaaaacaacctctcttttgataccgaatatcctgcttgccaatatgacgaatatcatcttagatgtaaaaggtgacctgttgaaaaattacgggggatacctgaaagaaaaaggtgtgacagtaaaaagccttaactttaaagatatgttacaatctgaccaatataatccatttgtatatatagataattataccgacatggtagagcttatcacaaatatccagacatcagtaaaaccgccagatgcccaaaagggtgacccgttttgggatgacggtgttggtctgtatctgcagtctctctttgaatatgaatggcttcaggcgaaagaagaaaaccgtgttgcatccatgccagggattttggaactggtaaacagggaaacacaaaagatagatgaggaagggacaacacagttacagcaggatatgtacagattacaagagaggtatggagtagattatccacctgtgcgggattatagaaaactgaaggaaggagcatcggaaacagtccgttctatcgttatcatggtaaatgcacagttacgcctttttgaaatcccagaaatcaagagaatctttgaaggaactgacgatatagatattccatcacttggattaggagtagagggaaatccagaaaaaaagactgccctttttcttgttatgccatcaggggattcttcctataatctttttatcaatatgttctacacacagttattcactgttttaaaacgtatcgcagatgatcggagagatggacagttacctatccatgtgcggttatgggcagatgagtattacgctggtccaaaacctttaaactgcgaaacgcttctgggagagatacgaagcagaaatatgtccattgttcctattttgcaggatatagcacagataaagaccttgtatccaaatgataaatgggaaatattcacgggaaactgtgcaacaacggtatttctcggcagtggtgctactgcacatacaacacatcagtggatatctgatatgttagaggatatgacgattgacagccgttccgaaaatttaggacattcgcagggaggaggaaacctgcagatgagcaagggtggaatgaagttaatgactccgggacaggtcagccggatgccgaaaaatgattgtatcctgtttctgaaaggagaaagaccaatctatgataagaaaaactggtcatttgatacagaagtatttaaagaagcacaggagatagcagggaaaaatggttataaaaatcctgtatatgtatcgtatgatgaagaaaacaggcaatacactacaacccgtttcgaatcaagactaaattatatctcacaggaagattatgaattttatgaagaaaaagccaagacggatgataacatacagacattccagatagacgaagatgcttttctatatcttaacttcaacgaaactccgcagccaagccttcgggagttagagaagatggtgaaaaagatacaggtttcagaaaacagtgaagatgatgaaaatgaggaggacgaaaagaaagaagatactgtgcaggatagaaaaaaatgggatttatctggagatattatggactgttttcagcgatattccagtgaactgtcgcaggaagagcaggaggaaatcataaaaggtatcgaagatggcttaacagatcaggagataaagagatattttgccttgtacggagcagataaaatgcaacaatacagaagggttctcacggcaagaaaaaacagagggtagatacaaaaaagcagaaaagactttaagtcctttctgctcttttttatctcctctctcctaaatctctttacgcctgtcaacatgaaaaaataaaatgtgccgaatttcggtacacaaatagcaaagcataatatatttaaaaatttaaatttttcctcatagaatttatataaaaatccttgattaaagaaatatttgcgttattattttaagacaaatgaatcaggagaataacgattaaaaaagccccggaaacaaattgacatgtactattaaagtaagatatatatgtagtacaaatgtaggtataggcataaaattaaggtgggaataatttatggggaaaaaatggagacaattaaaatatgaagatagattaaagatatatgcctggttgcaggataaaacatcggttgcaactattgcaaaaaggttaggtgtctgccgtcagacaatctatcgtgaaataaaacgaggggaatttgtaaaaagaaatacggattacacggaatcaacggtatacgatccatatgttgcagaggaacattatcaaaaaaaattaaaggaacgtggacgaaatctaaaaataggcagtgatttaaagttgttacattatatagaaaaaaagatagtagatgaaaagcgttctccggcggctgccttacatgaaataaaaaaagaaggaaaagaatttacagttacattaagtaccaatactatatatagttacataaagaaaggtatctttttaaatataacgatggaagatttgccggagaagaaaaagcagcacaaaaagaaaaaagtaaaggtacaaaagagagtgcaggcgggggatagcatcagccagcgtccagaacatattgatttcagggaagaatttggtcattgggaaatggatacggttgtaggtcctcaaggtaaatccaaaaaagtcatgctcgttttaacggagagaaaaacaagaaaagaaatcgtgtatctgatgcctgacagaaaggcacaaacagttgtaaaaacattaaacatgattgaaagaaagtatggagagcgattattccgtgatgtatttaaaacaattacagtagacaatggagtagaattttctgatgcagaaggtctggaaaaatcgagaagaaataaaaagaaaagaacgaaagtatattattgccatccatatagtagttgtgaacgaggttctaatgaaaatgcaaaccgactaatccgacgtcatataccaaaaggagttaattttgataagaaaagtaaaaccgaaatcaaggaaatagaaacatggataaataactatcctcgtaagatatttgagtatgatacagcagaaaatcaatttattaatgaaatggaaaaattaacaggataaagctaagaggtgcatatagaaaatggctgccggaagacagtcttttttctatgcacttttttaaaaaagatgacaaaaataattgtaattgaagccgaattatgtcattataaataatgaataacaggtaaacaatgttaaaaatttttttgaaaaaatgttgcaaaaaaacttgacattttcgtgtatacaaggaaaacaaaagaaaaccttgacaaaagaaaaatagtaatatattatgaaccctagtaaggaaatggaaattgaggagcaatattatgatgatgatgatgtgtgtcatgccaatgaattacataacttgtagctgtgaagattcacagatggatatgtcttctgtgagggagactggcttgcctgcacataatgatcagaatgcgtgtttatagattttcagaagatttgtttgaaaagagcttgagaaggatggattaccagagcttttatttcggcagagattataattttcatgacaccagggatgagtttcaagcaggtagtgatacctgcttttttctttcataccaaaaagaaacttaatggcaggtaaataccgaccacaggctgaaacaattttcataaaaaccagggaggaagaataatggcagagattgtaatagagaatctctataagtcttttgatacaaaagatggaacagtagaggctcttaaaaatgttaatttaagcatcgagtccggagatatttacggtattatcggtatgtccggcgctggaaagagtacattagtacgatgtattaactttcttgaagttccgacaaagggacgggttcttattaatggaaagtctttaggagattatacttcaagagaacttagaaagcagagagaagatatcggaatgatttttcagcatttcaacttactgatgcagaaaaatgttttggaaaatgtttgttttccgttgtatattcagggaaagtccaagaaagatgcccaaaagcgtgcaaaggagcttttagatatcgttggacttggagatagaaccggagcatttccggcacagttgtccggtggacaaaagcagagagttgcgattgcgagagcattggcatctgatccaaagattcttctttgtgatgaggcgaccagtgcactcgatccacagacaacatcttctattttagccttattaaaggatatcaatgaacgttttaatattacaatcgtaattattacacatcagatgtctgttgttcgtgaaatatgttctcatgtagcgattgtaaaaggcggcgaagtagcagaacagggaacggtagaagagatttttacgcatcctaagactgcagtggcaagagaactccttaagaatgatgttggtgatggagaagaaaagagcagaaagtcaacaagtggtaaggacctgatacagagtggagaaaagattcggattgtcttttccgagaattctgcatttgagccagtcattgccaatctgattcttaactttaacgagccggtaaatattttaaaggcagatacaaagaatgtccgcggtgtggcaaaaggagaaatgattcttgaatttgcgccggactgtacaaaaaataaagaaatgaaacagtatcttttagacagaggtttagatttagaggaggtgaatgagaatgtggactaaagaaataacagatatgatcgtcagtggtgtatgggcaacactttatatgacacttgcttctacaatcttaggatatatctttggacttccgatgggtgtccttttagcaatcacagacaaagaaggattaacaccaaatgcaatcgtatataaaatattagatgtcatcgcaaatatcgttcgaagtatcccgttcctgatccttcttattctgcttattccatttacaaagctgatcgttggacaaagttatggttctacagcaaccgttgtaccacttgtgatcgcagcaattccatttattgcccgaatggtggaatcttctattaaagaagtagatccgggtgttattgaggcagctcgttctatgggagcaagcaatatgcagattgttatgaaggttctcttagtagaagccagaacatctttacttaccggagcaacaatcgcaatcggaacaattcttggttattctgcaatggcaggttgtgtcggcggtggtggactcggtgatatcgccatccgttacggatattatcgttatcagacaagtattatgatcgttacggttgtactgcttgttgtacttgtacagattttccagagtattggtatgttccttgcagccaaacttgataagagaaaataaaactcagatcaattatagttatcaactatttggagtcagcaaatttaagtcgagcaaccacgagacttggcgcgtgattctggttagcgtaagctgacatattctttacagaatcactgcgcatcctcgcggagcgtttatcttagtcggagattggactctcactgagataaatttgctgtcactccccacctgaaagaggtgggagttttctcgactgagataaaagactctctgaatagttagaataaataaaaaatgcactcgggagtcttcttacaaatcatgcacaaaagactcggagagcacataaaaagaaagagaggaaacagacatgaagaaatttggagcatttttattagcaggcgtactcgcaattggaacattaaccggatgcggaagtacagataagaaggcagaaggttctacaggaagtacagatagcaaagtgattaaggttgcagcttctgcaactccacacgcagaaatcttagaagaagcaaaaccacttctcgaaaaagaaggatatgacttagaggtaactgtatttgatgattatgtacagccaaacgaagttgtagacagtggagattttgatgcaaactacttccagcatgcgccttacatggaacagttcaataaagaaaaaggaacaaaattagtagatgcaggcgatattcactacgagccattcggaatctatccaggaacaaagaaaagccttgatgaaatcgcagatggagatgaaatcgctgtaccaaacgatacaacaaacgaagcaagagcattacttcttcttcaggataacggtattatcaagttaaaagacggtgcaggactcacagcaactgtaaatgacatcgcagaaaatccacacaatattaagattgttgagttagaagctgcacaggtagcacgtgtaacaggcgagacagctttcgttgtattaaacggaaactatgctcttcaggctggctactctgtaaaaaaagatgccctcgcttatgaagcagcagattcagaagcagcaaaaacttatgtaaatatcatcgcagtaaaagacggaaatcaggacagtgatgcaatcaaagcattagtaaaagttcttaaatctgatgacattaagaaattcattgatgaaaaatacgacggtgcagtaattgcatttgaataataatttgtagatttcgtatagacgaaaaaagaaaaaataccatatcccatctgctctgtagtcgctgtgtttaagatgcttagccgcatcttaaacacgctccgaagccgcatctgggatatggtattttttcttttttctgactatcctaaacccacagttggtgagaatgagggattaaatacgaatttgctggggacacagacgccgctttagtagaggatattgagctgaattgtagtaagtcttttttctttaccatagttttcttacaattcagcataaaagtttattttggcggctgtctggttttgataacaaatagcaaattagttatttctgttggaaagagaaggagattcgccagaagattatgatttttaatcagagaactgtttcaccataagaaaatagcagtgaaagccaaattcttccgattgccccgatttctttccctattaatatccttacaattccgtaagaagatatcaccatctggagattttcattctaacgaaaaccatagacttctgggcaatccccattctcaccaactgtggatttagtatagtcagaaaaaagaaatactggcatatcccagatgcggcttcggagcgtgtttaagatgtgaacgagcattttaaacacagcgactatagagcagatgggatatgccagtatttcttttttcgtctacaccaaatctacaaattcgtattttgatgcttctgtacctatatctgtgaggatacccataacaggacggtaaggcatggcaaatcgttgggagagataacgcatcgcagctccggtctccccatcagggccgccaaattgcgagatgattgcttttgccatggctgcatcagttctctttatattaattggatactctaatcttttttcataattccacataaacctatccctccatttcccatggccatggtttattagcccatgcccagaattctgtgtcttttggaactgtatcaagattcagaggtgagaagcggctgctatattctttgatggcctgctttcttgcatttttataatattcaaaatattctaaagcttctttgctttcaggatgtgtatcaagaaacatggcgcagtctagtgcagcaaagcttacaagatcaatataacgtttgagttttttttgctcggcgcagcagctacagccgttgttataattgcggttatgattggaattagaattcatgttgcggttataattacagttaaaattacagttttcagaagaatttatattttgcatcatttttggcacctccttccaagaaaagccagatcaagttcctgaaagattgtgccggcacataatgcgttttcaggtttatatatattctgccatttctgccatggtacataagccatagcaagagacagggaatcaagttttacagtttccttttcctgtgtgcatgaacaggaagaatgataagaattatccatcataaaagcatctccttgttttgtaagattcataactattcagagtaatacagattctaaactattatggaatctgtatttaaatctgtggatgaacgctccgcgaggatgcgcagtgattctgtaaagaatatgtcagcttacgctgaccagaatcacgcgccaaatctcgcggctgctcgacttgaatttgaaaagttaatctgaacagttactataatttatatatatgacaaggagtgaaatgtgtccgtaagatatgtatttcagactgtatacaagttcaataaataacctgttataaaaatacaaggaatctgtattagcaaatgtaatattttatggatattgttataagagtatcagaaaatgattcaaaagtttggaaagtgtacaaattgacagaaatatgcgggggggggtataatataaaaataactgttttatttcagaatatgttagttccccaaaataacatattagaaatccccaaaacagtgagagagtcttccggagaatctgttttttcggaagactttttttactttacaggaaattgttttcctgtaaagtaaaaaacgatccgcgagaatgtgccaaggcacattctttgttctccaataaaaagaaattgcacacgccttgcatttttgtaatctgaactgtataatataagattgaatataaattgctttattttttgtagagaaaggaatggaacaatgacaaagatagatattatttctggttttcttggagccggaaaaacaactttaattaaaaaacttattgaagaaggactgaagggtcagaaggttgttctgattgagaacgaatttggtgagattggtattgatggtggatttttaaaagagtctggtattcagattaatgaaatgaattctggatgtatttgctgttctttagttggtgattttaatactgctttaaaagatgtgttagaacagtatacaccagatcgtattatcatcgaaccttcaggagttggcaagctttctgatgttatgaaagcagtacaaaaagttgtggatgcagaagagaatgtcgtattaaacagtcatattactgttgcagatgcaatgagagcgaaaatgtatctgaaaaactttggagaattttatcgtaatcaggttgagtttgccagtgcagtgatcttaagtcgttcacagaatgtaaaagaagataagttagagaaggcagtagcgcttcttcgtgatattaatggaaaatgtcctattgtgacaactccttgggaagagcttagtggggcacagcttcttgaagtaatggaaggtgagaatgattttgctaaagaattgatggaggcagcacaggtttgtcctgaatgtggacatcatcatgaacatggtgaagaatgtcacgatcatcatcacgacaatgatcacgaatgtcatgaacatcatcacgaccacgatcatgaatgtcacgatcatcatcacgaccacgatcatgaatgtcatgaacatcatcatgaccatgatcatgattgctgtggtcatgaccatcaccaccatcatgcggatgaagtatttacaagctggggaaaagaaactcctaagaagtatacagaagaaggaattcgagcaattcttgatacattatctaaagaagactccaatgagtatggaattatcttaagagcaaagggaattgtaccggatgaaaacggtaaatggattcattttgatcttgtaccaggtgaagatgaagtacgttacggttctgcagaatatactggacgaatttgcgttattggttcaaaacttaatgaagacaagctggaagagctttttggtttataaaaatgtactctggaaatttttttggtaaaaacagggacaaaagattttgagaatacacaaaagcccacaggaggagatgtatgttaagtagaaagaagaaactggaaatcccggtatatttatttatgggatttctggaagccggaaagacaacctttattcaggaaacgctggaagaagattattttaacgatggagagagaacacttttattcgcctgtgaagagggaatggaagaatatgatgaagaactgttaaaaagaacgaatacaacacttgtctatgtagaagatcaggaagattttaatacagaatttcttaccagtaaacttttggagcactatccggaccgcgttattatagaatataacggtatgtggaccattgatcatatggtagaag

SEQ ID NO: 454 - DNA, 17807 bp, Eubacterium hallii
cagacagtaatgcgtgataaaggaattgctcatatcggaattggtgttggaagtggtgaagataaggcagttgatgcgattaagagcgccatggaaagtcctcttcttgagaccacagtcagtggagctaccgacattattatcaacttctccggtgatattggaattcaggaagtttatgaagcagtatcttatctcacagaagttgccggtgacgaagcgaacattatctttggtaatgtagagagcgaagatgtaccagatgatgaagtaagtattacaatcattgcgacaggactccacgatgtttccggaaagggagcatctgctgtaagagtgaaccgaaaaccagcagcagataagaatgtagaagggaatggacctacttatagcggacaggcaattaagtcagcgcagagtagcagaacttcagagaatcatgagacaacacgaacttatgataacagagacatggagattaagattccggaattcttacagaaaagaagataatacataagtaagagttttcctcttttaggcagacaatgtcgccagaggtcgaataataaagaatttttctttattatttcgacctcatttttttatgcaaatttatataataaattaaccacataacagtaaaagatgctatgaagcaaattcatccgattctattgcaggtttgttacaactttgtggcagactatattatactgttctttataaaaagagatttatttccagaaaagaaacaatctcaaataataaaggcagccgctattttctcaatgacttatgtaatctgggaatggacaacaacaggaatgtccccagttataagagggattcttaaatggtgtagtatccttgctttaatttgtcgattttttaaaattacttctgtttcactttttagaaaaacaataacagtattcttatgttacttgtttttgatgggaggaagtgtcactttttttcttacatatatacagattgaccaggtaaaagcaataaaagaagcgtacaaagcaatcgctgtactgtttttatcatcaggaattcttttagcatataaaagaaaacaaaaacaggaaaagcgtgaagaagaagcccggaaaaatatatacgatatacagatttcaagaaaaggaaaaacaataacatgtcgagggttttatgattccggaaatcttttaacaagtcgtattaccggacagggagtatgtattataacacaagaaaaagcaagggaaatattaatgccaaaagaacagcaagaagtaaagaaaattcttacaggctcatcggaaagtctttcatggaaaatgtgggcaaaacagtttcaggaagggatgtatatattgcagtattcctccgttggcaaaaaaaatgcaaaaatgcccggagtcatggcagaacagattgttgtgttgaaaaatgaggaggtgcttgtaaaaacaaaaggaatgcttggtatcagttcggaaaaatttgtagaacagaatacattttctatattacttccggccgatatttttgaaagagaaaaaaatcgaaatatcatttgatggagggcaaaagtatggcagttgtattaaatgcatcaggagtaaacagagtaagatttacagtgataaataatatgaagtcactatttcatccacagcgggaaatacactatattggaggaacagacatccttccgccgccattagaaccagaagaagaagcatacgtgttaagtcagctagatacaaaacgaagtgaagaagccaaagcacttttaattgaaagaaatttacgattagttgtttacatagcaaagaaatttgaaaatacaggaatcggagtcgaagatttaatttcaattggaacaatcggactgatcaaagcaatccatacctttaaattagataaaaaaataaaactggcaacctatgcctcacgttgcatagaaaacgaaattctcatgtatctcagaagaacaaataaaacaaaactagaagtatccatcgatgagccattaaacgtagactgggatgggaacgaacttttactatcagacatcttaggaacagacaacgatgtgatttcaaaagatattgaagacgagatagatagaaaaatgctgaataaagcaatggaaatattatcagaaagagaaaaactgattattcggttacgtttcggtataggcggagacggaaatgaagaaaaaacacagaaagaagtagcagatctgctgggaatctcccaatcttacatatccagactggaaaagaaaataatccatcgactaaaaagagaaataataaaaatggaataaaataccaattcgttagagacacagacgccgctttagtagaagatattgagctgaattgtagttagtcttctaaagaaaaaagaattgtgataagtttgattttgttccgttgcgctaaacgtttcattttgcctcaaaaaacgaaaacttcggaaaaatgagtccgaagttttcagagtcaaaattccacagcgcaaagtcacaaaatgcaatacttatcacaattcttttttctttatcgtagtcttcttgcaattcagcataaaagtttgttttagcggctgtttgtttttgataacaaatagcaaattagtgatttctgttggaaagagaaggggattctccaaaagatgatgtgagctaaccagagaaaaatttttcataaggtaagagtaggtaaatgtaatttttatacaacaaaataagaaagtgtcttctttgggcgatgttccttctaatgaaaaccatagccttctgggcaatccccttattcttccttaaatccaaatactaatttccttctggggccaaaaaacagaaaagcagaaatttgatatagaagaaaatgtgatgtcggagctagtaaaaatgccggtcaggcattttctacgaagtgactatcttcacattttcttttatatcaaatttctgcttttcgtctctttagtccagcaaattagtatttttcaataaaatttcttatggatttcagtgcatttttttcaaggcggctgacttgcgcctgcgatatactgatttcgtttgcaacttctgtctgggtttttccttcaaaaaaacgttttttaataatatgatattcccggcccggaagttgattcattgcttcctggagggagaggtgctctacccaggtttcttctttgttctttttgtcacatatttgatccattagaaaaagtggatcgtttccatcttgatagaccggttcaaataaagacatgggtgtggcaatagcatcaagagcgtaaatgatatcttcttcagaaatatctgtttcttttgcaatttcttctatcgtaggtgtacgattcatagattttgtgagctgttcttttgcataaatcgctttgtaagcggtgtcccgcaaagaacggctgacccgtatgctgttattatctcgaagatagcgtcttacttctccaagaatcatgggtacagcataagtggaaaatttaacatctaaactacggtcgaaattatccaccgctttcataagaccgatacagccaacttgaaacagatcatcagcatgttcatggttattagaaaaacgttgaatgacacttaaaacgaggcgaaggttcccttttacatatttttcgcgagccgctttatcgccacgttcaattcgtagaaaaagattttctttttcttcattggacagaagtggcagctctgaagtatttactccgcagatttcaactttgtttaaaaacatcgctatcctcccagggtgaaaaaatttgaaagcatataaaatcaatgaaaaagattcttagagtataataaaatgcatctgtataaaaggatgaacttaaaaaagtaaaaatattcatataaaaggtgaatatatttagaaaatctgttataatgaaaaaaataagaaaaatggctgcacatttttatggaaaagttcagattgaattttagattagtttttagattggttaggaggatgcaggatggttgcagaaattgtatgtgtgggaactgaacttctgctgggagatatcgtaaatacgaatgcacagcatatatcaaaagaacttgctcatataggaatagacttatattatcagacggtagtgggagataataaagaacgtgtgtggaatgtattggacactgctttaaagcgtgctgatctcattattatgactggtggattaggaccgacaaaggatgatcttacaaaagaagtggcagcttctttttttgggaagaagttagtttttcatgagcagacatatgaacatgtaagaaaaagattagaatcttatggaattagtgagatgacagaaagtcagaaaaagcaggcattagttccagaaggtgcccttatagttacgaatccggcaggacttgctccgggaattattatggcacagggagataaggcgattgttatgctgccgggacctccaaaagaaatgaaagcggttctttcagagtgttgtcatctttttattaatcgcctttctgatcaggtatttgtatcaatcaatatcaagtgtaaggggccggatgaacttccattaaaagaaattggggaagcaccggtagccgatttattaggtgatattcttgataatgagaatcctactgttgcaacatatgcaaaagaagatggagtgttaatacgtgtaactgcttccggaaagacaagagaagaggctcttacagctatgcagccagttgtaacaaagattgcggaaatacttgccggaaagattgcgtgggtaaaggaagaagtataaaaatattaaaattgaaagaggaaaaaagtggaagcatctagtttaaaaagaatagcaaacaaatacacacagaccagtctgattttacgtattttaatcggtatggcaatcggtgtggtactggcacttactgtgcctgaatttacaggaatcaagattcttggagacctttttgtaggggcattaaaggcaatcgctcctttacttgtatgtcttttaattatgagttctttagctcagacaaaagaaggacataacgggaacatgaaaactgtagtaatcctttatatgttcagtaccgtaatgggagcgatcgtagcggtagcaggaagctttttattcccattaaaaattacattagcagatgctgtacagcaggaagcaccaaaaggagttgtagaagttcttgaaaatctccttttaaaaattgtagcaaacccaattgatgcattggtaaatgcaaactatcttggcgtgcttgcttgggctgttattcttggaattgcattaaaaaaggcagcaccaggaacaaagcagatgctttctgatgcatctgatgcggtatctcaggcagtacgatggattataaatcttgcaccatttggtattttaggacttgtatttaatgcggtatcgacaagtggtattcagattttcacacagtatggaaagctcatacttttactcgtaggatgtatgttattccaggaattcatcacaaatggtattattgtaggattttgccttaagaaaaatccatatccattaatttcccgctgtgcaagagaaagtggattaacagcattttttacaagaagttctgcagcaaacattcctgtaaatatggaactttgcgaaaaaatgggcttagataaagataattattccgtatccattccgcttggttctacgattaatatggatggagcagcaatcacaatcacagtaatgaccttagcagccgcatatacactgggaatcagcgtaagcattccaacggcaatcgtgttaagtattttagcaacactttccgcatgtggagcatcaggaatcgctggaggttctctcctcttaatccctgtagcatgttcccttttcggaatttccaatgacattgctatgcaggtagtaggtgtaggatttatcatcggtgtaattcaggattcctgtgagacagcactgaattcatcttctgacgtattacttactgcaacagcagaatttatgcagtggagaaaagcaggaaaagaattaccattttaaagcttgaattgccgcaggcaaggtagacgaaacagacgaactcagaaagaaaaataaagcatatttgtggctttagtcgctacaggttgaatgttcgcttaaccgctcgcatccatcctttgctccgaggtcacaaatatgttttatttttctttctgggttctgtttgttggccgtctatgcaaacgcagaatttatatattcaatttaaagggattgataaattacttcaagtgtctagtcagtatatagtatcgaagcaaaacttaaatttcgatttcactccaacagccaaagacagcctccgaagcgagccgatagcctatatttgtggccttagagcaaggattgaatgtgagcatggaagcgaacattcaacccgcagtgatagagtcacaaatataggctatcggctcgcttcggaggcgtctctttgcctgcggcaaattcgaaattaattccctcttgactagcacacttctttctgccataatagcctttgaaagtttaactatactaaactttaagtttatctcagtcgagaaggctctcacatctttcaggtggtgagtgacagcaaatttgtctcagtgggagtccaatcttcgactgagataaacgctccgcgaggatgcgcagtgattctgtaaagaatatgtcagcttacgctgaccagaatcacgcgccaagtctagcggctgctcgacttgaatattacataaatagaaaggtgtgaagtcatgaatcatggaactaggagagaagattaaagaattgaggaataaacagggacttacgcaggaagaacttgctgaccgggcagagcttagtaagggctttatttctcagttggaaagagatatgacctctccctccatcgcaacattagaagaccttcttcaatgtcttggaacgactctcggtgaatttttcatggaggaacaggaagaggaacagattgtgtttacggaggaggatttttttgtaaagaaggatgaggaatataagaatcagattaagtggattattccgaatgcacagaagaattgcatggagccaatacatttgattttagaaaaaggtggggagacctgtctagataatccacatgaaggagaagaatttggctatgtattaaaaggtaaagtagaaatccatcttgggaagaaaagttatattgcgaaaaagggagatgcattttattataaagcggataagacacattatttaaagggtattgagcagacagaattaatatgggtgacttctccgccgagtttttaagcagcaagaatgttgagacattcttgaaaaatttaataaaatttattgaggaacagggaatgaaaaataaattagttgaattggtgaatatttcaaaatcttttggttcgaccaaagtattagatgagttgtgtttagaggtaaaggaaaatgaattccttactttacttggaccgtcaggttgtggaaaaacaacgacattacggattatcggtgggtttgagagaccggacagtggaaaggtactgtttgatggaacagatattacgaacgttccggcaaataaaagaaacttaaatacggtatttcagaaatatgcgttgtttggtcacatgacaattgaagaaaacattgcctttggattaaaaattaaaaataaatcggatgcgtatattaaagataagattaagtatgcgttaaagcttgtaaatctggaaggatttgagaagagaaaaccgacttcgttaagtggtggtcagcagcagcgaattgcaattgcaagagcgattgtaaatgaaccgaaagttcttttattagatgaaccgttaggcgcacttgacttaaaacttcgtcaggatatgcagtatgagttgatgcgtttaaaagaagagctgggaattacatttatttatattacacatgatcaggaagaagcgcttacgatgtcagataagatcatcgttatgaataagggatatatccagcagatgggaacaccggaagatatttataatgagccggaaaatgcctttgtagcagattttatcggtgacagcaacattattgatggaattatgttagaagatcgtctcgtggagattcttggaacgaagtttccatgcgtggatgaaggatttggaaaaaatcgtcctgtcgatgtcgtaattcgtccagaggatgttgttcttaaaggagaaggagaaggaatcattgacggaattgtaacttctcttattttcaaaggtgtgcattatgagatggaagtagaggcgaacggatatgaatggcttgttcatagtacaaattgctatccggtaggttctagagtcagtatttctgtaattccgtttaatattcagatcatgcataagccggaatcagaagatgaaaaggcggtggtggtggatgagtagaaaggttcttacatctccgtatattgtctggggagcagcatttattattttgccattatttatggtgatatactatgggtgtacaggaagtgacggaagtttttcactatctaatattacagcaatggcagatccggtccattacaaagcattctggaattctgtctggattgcgatggcaagtacaatgatctgtctggtgatatcttatccgttagcatatattttaagtaaaggaaagcacagaggttctggtgttgttattatgctttttgttttgccgatgtggatcaactttcttcttcgtgttctggcattacaggttattttatcaaaaacaggaattttaaatgcaatccttggctttttcggattacctttgcagaagttaatgtatacgaaaggagccgtactgattggaatggtttatgattatattccatttatgattttgccaatctataatgcactttgtaaaattgataaagatgttattgaggcagcgcatgatttaggagccagcgccagagtaacatttcagaaaataataatcccattgtccctgccgggaattatcagcggaattattatggtatttattccaagtatttctgaatttgttgtggcagatattttaggaggctcaaaagtacttctttttggaaatgtcattgaccaggaatttaatgtggcaaataactggaatttaggatctggtctgtctatcgtacttatgatatttattttcatcagtatggcgatcatgaatcggaatgcatcagaggaaggagatagtatgctatggtaaaagtaaaaagttttattgaaaagttttacgtggcattcataggtttccttctctatgcaccattgcttgtactttttgtatgttcctttaatgattcaaaagcaagaacaatatggggagggtttactcttcactggtacacagacttatttcagaatgaggaagtactttcagcagtaagaacatcgctgctgcttacgacacttgcagcgttgatcgcaacattaattgggacacttgcctgtattggaatgacagcaatgaagttacgatttcaaaaggtaatggaaggacttgcgaatatcccgttattaaatgcagatattgtaacaggtgtggctatcatgcttttgtttgtgcatttcatgtcattaggatttacctccatgttgatagctcatgtaacgctggggctgccatatattattttgaatgttatgccgagatttcagcagcttgataaaaatgtatacgaggcagcgcaggatttaggggcatctgcagtatatgcctttgtcaaagttgtcctgccggaaattatcccgggaattgtctcaggatttttctttgcatttaccgtatcgatggatgactttgttgtaacttattttacaaaaggggcaggaatcaatacaatttctacaatgctttatcagcagcttcgaagaggaatcaatccacagatgtacgcactttcgacccttttatttttgacgattcttattttactcggactcattaaccatatgtccgcaacaaaacaaaaaaaagcagacaggagggaagaacgatgaatatactggaaaaatattatctgcagggaaaaggcaagattatacttggaacttttgcattgatcgttcttttcattatttcgacggtaatgtttaccggctgcttctcttcgaatcaaaaaaatgacaatgaaaatacagttactgtatttaattatggcgattatattgatgtaaatgtcttaaaaacatttgagaaagaaactggaattcaggtgaaatatgaagaatacgttacgccggaagatatgtacaccaaatataaatcaggagtgatcaattacgatgtgatctgtacttcggactatatggtggaaaaaatgatgcaggaagaagaagtacagaaaattgatacatcttctatggaatattataaaaacattgacaagaagtatcttgatttttgtaaagtatttgatccaaccaatgaatatgccgttccgtatttgtggggaacagtaggaatcctgtataatacaaaagtagtaaaagaaaaagtagatagctggagcattctatggaataaaaagtatgatgatcagatcattatgcaaaatagtatgagagatgcatttatggttccgcttaaatggaaagggctttctttaaataccacgaatccaaaagaattagtgcaggcacaaagtcttttattaaaacaaaaaccaattgtggaagcatatcttgttgatgaggcaagagatgcgatggtttccggagatgcctccatggcagttatttattctggagatgccaccgttgccatggaagaaaacgaagatcttgattatgttgtgcctaaagaaggttccaacgtatggtttgactgctttctaattcctaaaacagctgaacataaagaggccgccgaaaagtttatcgactacatgagccgtcaggacattgcccagaaaaactttgattatatttattacggaacaccaaataaagccgtatacgatgccttagatgatgaaaccaaagaagattacacgatttttccggaagaagcgactttaaataaatgtgaagtatataaataccttggtgaaaagaccgaccagtattataatcggctgtggaaggaattaaaatcatattaattaaaaaatatatcagaaaggggaattcttatgaaacataaattaacccagcaagatgtagacaaaatgaaggcagaaatcgagcaccgcaaagtcgaagtaagaccggaactgctcgaacatgtaaaggaagccagagcacatggtgacttaagtgaaaactttgaataccatgctgctaaaaaagaaaaaaacagaaatgaaagccgaatccgttaccttgaaagaatgattcgaacctgcgaaatagtagaagatcactctgatgccgatcaggtaggtttaaacaaaacagtaacactctactttgaagaagatgacgaaaccgataaattctccttcgtaactaccgtactcgtagatacgatgcaaaatcgcgtcagcattgaatcccctttaggaaaagctcttctgggacacaaaaaaggagaaagagtttatatacctgtaaatccacagtatggatactatgtcgaaattaaagaaattgaactctttaacgaagacatacctttgaatcaatactgatttgtaaatttggtacagacgaaaaaagaaaaaatgccctatcccagatgcggcttgggagcgtatttaagatgcgggtgagcatcttaaatacagcgactacagagcagatgggatagggtagtttttcttttttcgtctataccaaatctacagatcagcattttcttcctgtagatttgcgtacgattaactgtggttcatattccagtctcataatataagaacgagaggattcttcttttttctgtgtattttttcgatggatcatatccaccgcttcttctccttttcgcactgaagcatggtcgatcgtagtgagtgaaatctgtggcatggcagataaggtaatgttatcaaagccacagacagaaaagtcagacgggatgcgataaccatggtcggaaattgctgccatgattccaaaggctgccatgtcattatttcctataaaggcggtagaggaagttttttcttctaaagcgcgggttgcaagatcataaccgttttgatattctgcattttcaagaggatagcgatcaaaagcaggctggttttggtagagaacagtaaggtgctctaaggggataccatgctcacgaaaactagatttgataccatcaagacggtggattcttccaatttcttttccgcgaatcggagtagaaatgtaagtgatgtctgtatgacctaaagaaagtagataattagccataatatgtccctgtttacggctgtcaagttcaacagaatcaaagtggcaggaaagcggtttgtctcctacagaaataaccgggaaatgctttgcaagagcgttgattttctggatctttgacaatggataaagactgatgatgccggcaagttgtacgcgggaaaataaatcgagatagatttcttctgttgcagcatctcttccggtagaaattgtcataacagtgtagttatatttctttgcgtgatcggtgatagactgcatcatcatcgagtaatagccgtttgtgaccatcgggcatagcacgacaattgtatttgcaagagatttttcctgtaccagttcttttggtacaggttttttgtatccaagctcttttgcctttgcctttactttttgtacggtctcgtcggtaaaggatacatttggtttattgctgaggatcatagagacggtggattgggagataccaagttcttcagcgatgtctctggtggtgactcgattcctttttcccataaaaaatactccttttttgatttattttaattaatgattacgtattaatcttagtacatttttgattaataatattatagtattgattaattcattttacaaggtatttccttatgtttgcattttccttttttgacaggaagaaaaatggagcgaaaaaacagaggattaatcaaatgaaatgattaataaaaatcaagaaaatatctagtaaataagcggtttttagcatttgactttgttaaagaaatatggttagatatagccatcagataacgaaacaaaaacaaccaaaacaaagattttatttaagatttttcacaggaggatttaaaatgagtgttattacttttgtttgtgcaggtcagatgaattcagcaattacttttccagcttttgaaaatggtcatgaggtaagattagttggttcccctcttgatagagacattatcgatggattaaagaaagataattttcatattacattaaagagaacgcttcatgatggcatcaaatattatcagattgaagaactagaagaggctttaaaaggtgcagatttagttcttggtggtgtaagcagttttggacttgactggttctgcgatgaaattcttccagtgttaccagaggacgttccagtacttacggtaacaaaaggaatggttgatttagaagatggaactttagttccgtatccacatatttttgcacagagacagccgaaaggcaaacatcttaacttaaatgcaatcggtggaccatgtacaagctatgagttagcagaccatgatgatagccacgttgctttctgtggaaaagacgtagagacattaaaatatattaaatctcttttagagacagattattatcatatttctctttctacagatgttgttggtgtagagtgtgcagttgcaatgaaaaatgcctatgctttaggtgtaagtcttgcggtaggtcttgcagaaaagagagatggaaagattggaagtcagcattataattctcaggcagcattatttggacagagtgtaaaagaaatgacaagattacttgagcttattggtggcaaaccggaaaatattattcatggtgcaggcgatttatatgtaacaatctttggtggaagaactcgtaaaattggaactttattaggaagaggtctttctttcgaggaagcaatggcagagttacaaggagtgacattagagtccatcgttatttccacaagaacggcaagagcggtaagaaagcttgcagaaagaggaatcgtttctttggaagatttcccattattgatgcatgtagatgcaattatcaatcagggagcagaagtagatatcccatggaaagactttacatggaatgacttttctttagtagagtaatacggtatcaggataatacggttaggaaagagaaggagaatacttatgagcaaatatgcgattgggattgattatggtacattatctgtacgtgcacttcttgtagatatagaaacagggaaggaagtagctgcaagtatttatgaatatccacatggggttatggaagaacatattccgtcagggaaaaagcttccggtaggatgggcgttacaggatccacaagattatttggaaggattacttgttacagtaagagatgttgttgcaagaaataaaattcttccgggggaagtcgtaggtattggagtggattttacttcttctacggtaattccggtgaaagcagacaaaacaccgctatgtcatcttccagaatttaaagaggaaccacatgcttatgtgaaattatggaaacatcatggtgcggaagaagaagcaaaattgatgaatgatgttgctgtagcacgtggagaagaatggcttccgacatatggtggtaaaatttccagtgaatggatgtatccgaaaatttatgaaacactgcgtcatgcaccagaagtttatgatgcggctgatcgttttatggaggcaggagactggattatctggcagatgacaggagaagaaacaagaagtgcctgctgcgcaggatataaggcatattatcatcatgaaaaaggatatccatcaaaagatttctttaaagcggtagacccaagaatggaaaacatcgtagaggagaagcttgatgctccgattaaaggcgttggagaaaaagcaggacatttaacagcttctatggcaagagaaatgggacttatggaaggcgttccggtagctacctgtattattgatgcgcatgcttctttaccaggctgtggaattggtgaaccgggcaaaatgatgattatcgtaggaacttcttccgtacatatgatgcttggggataaagaagcagcgatcaaagggtcatcaggtacagtaaaagatggaattatgccaggatattttggatatgaagcaggacagtcttgtgtaggagatcattttgcttggtttgttgaaaattgtgtaccggaaagctatgagcaggaggcgcgtgtaagaggaatttctattcatcagcttctttctgaaaagttatcttcttataaagcaggggcaagtggtttgttagcactagattggtttaatggtgtacgtactcctttaatggattttaatttaaatggtttgattatgggaatgaatctattgacaaaaccagaagaaatatatctgtctcttattgaagcaactgcgtatggaacccgcatgataattgaaggattcgaggaagctggcttagaagtaaaagacattacattaagtggtggtattccaatcaaaaatgaaatgcttgtacaagtatattctgatgtatgtaatcgaaaaattaaagttgttgattccacacaatcaagtgcccttggtgcggcaattttaggtgcagcagcggctccggagcgtattacaggtttaaaaaatgctaatgaagcagcaaagaagcttggaaaagtaaaagataaagtctgggagccaaatcaggataacgttgaaatctataatgaactctatgaagaatataaaaccttgcatggttactttggaactggtataaatgatgtgatgaaacatttaaataatatcagggaaagaagaaaatagtacataactattccaattcatacatatagaaagtagtgcagcggtctgttgataaattaaaatgaacagactggtgcactttttgggtatattccaaacgcgctttatctcatcagaaaatatttttcaaacatattttttaatgagctataaaatagaaattgtgaaagtatatgaagtaaaaagtgaggtagcgaatgaattctttaaaaaagataaaagagtggcttaacacatttacagcttttaatgagcaggaacaagtggattgtcagcacataagacagtttttagaggaagaaccgaatcttttactgcgtgataatgtaaaaatgcattttacagcatctgcatgggttttgaatccgaaaaaagataaagttttgatgctttatcataatatttatcagtcctggtcctggagcggtggacatgcagacggagaaggtgatcttttatctgttgcaatgaaggaagtgaaagaagaaagtggattgctttctttaaaaccattattggatatgcctttatctattgaaattcttggtgtacagccacattataaaaaacagaaatatgtcagcgcacacctgcatttaaactacacctttcttctacataacacaaaagaagaaaaattaaaaatctgcccggaggaaaacagcaaggtgggctggctttctccagatgaagcggtacgttcatcaacagaagcgtggatgaaaccaatttatgagaaacttaaccagaagatgaaagagtatttgtaagatgataaacagacgaaccaaaggaagcaaacttacatttctgccaccacttctattttgcctctcttaatccggtaaacccatcttcaatttttctttatacattctttaattgattatggaggattacaacaaacagaaaagtgggggaggcggctatctataaaatgcgccttagagcaagtacaagttacggctgagtagcttgtacgcagcgaaacgaagcattttatagatagtctctttccccacttttcgtctattgaaaaagcaaatcaaaaaaataaaaaaaattgaaaaaagttgttgacatatgcagatagaagtgataatataagtgagtcgcttgcgagagcgaaacaaaatgaaaacatatggagaggtgtccgagtggtttaaggagctggtcttgaaaaccagtgatactgaaaggtaccgtgggttcgaatcccaccttctccgtattctttaacttgaatcaggaaggcattggattgcacatcttttaagtggagttttttcattgatagtatggagaagtacccaagaggccgaaggggctcgcctggaaagtgagtaggtcgttagtagcggcgcaagggttcaaatcccttcttctccgttgcgaatataatcgcaaaaaaagttcttgacattttcaagagaaaatgctagaatatacaggctgttaaaaaacagcaaaaataaaataaaaaaagttcttgacaaagacttctgaaagtgatagaataaagaagttgcgtcaaaaaaagaacaacacaaaaccttgataactgaataacaaaacaaccttgaacgttaattcaaatttcattcgggtttttctgagagtgatgtctgcaggaaagtccatggaacagaacgaaagttcaaaacctaaataaacagtaaagacaggaaaagaaccagtggttctggacctcgatctgacatcttaaaca

SEQ ID NO: 455 - DNA, 17340 bp, Eubacterium hallii
tccgactgagataaacgctccgcgaggatgcgcagtgattctgtaaagaatatgtcagcttacgctgaccagaatcacgcgccaagtctcgcggctgctcgacttgaatcttttattaatgcagctatcactgcaaacttatattcctgcagatctataatcaaaaacttaccataaacttggctttaccgcagtaatcagtctttcttccgccttcagatacgcttcatctaccattcgcttttcttctgtgcttaaattatgactttgtgcatagctctgccaggaagacatcgctaccagtaaatctgtcattgtcgtacaagacttcatcttcgtctcatatcttttgatttcttcgtctgttctgctcatattaacacctcacattttctcatctgattcggatatttcccagcctgatcttatccgcttataaaattccgaaaatatattcttattataagttgattttatttttgtagcaataaaaatatccatcctgtagctattttgttttgcactttttataacaaaaaaggacataaaattctaaaaaaattctatgtcctctttatttcattgcttcatccgttttataatcttgaaaaatattctaaagcctttgcaaaatctgcgatcgttttctctgcatcaccatgtgcaattccgtcttttacacaatgattcaaatgtccctctaatactacctgcccaatcttatgcagggcagttttcgctgcattaatctgtataatgatatcttcgcatggaacatcctgctcgatcatacggtcaattgccttgatctgcccatctactctttttaatcttttatgtaaattatccatatccatacattgtctcataaaaagtcccccttagtattcttatgtagtctcagaatctttcgatacttgcttttggggttaaattccgccagttgtactcaagtttccgcaatgttacacttcattcacaaacgactgtatattataaggtttagtatatcactattttaagaatccggaaatgatcatttcttctgcttcttcttctgtcagacctaatgtcataagtttaataagctgttcccctgcaatcttaccgattgctgcctcatggatcagttctgcatccagattgttcgcctctaattcaggaatcgcacaaacccttgcgttatccatgatgatcgcatcacattcgctatgtccggcacaggcattattacctgagatcttcgcgcggaacatctgataagaatcattacgtgcaacggaacgtgatacaacgttcgcactgcttccctcaccgtctaagtccactgcaaactgtgtttctgctttctgttctccatgtgtcataagcttctcagaaatctcaagctttgctccgtcttttaaatcggcttctgtctcacgcattgtgctgtcaattcccttaatctgtacggtatccatataaaaatatgcattctcgtcaagatgaatgatcgtttttggattcatcaccttaccgcctttgccgtcaccattaccataatgcttctctacataacgaatcttagaattcttcccaacaaaaaattcatgaataccatcatgctgtgaaagtccgtcaccaccattatgaattccgcagcctgctacgatcgtcacatcacaatcatcaccaatatggaaatcattataaacaaggtcggtaagccctgtctgactgatcacaaccgggatgtgcacgctttccttcttggttcccggcttgatgataatgtcgattcccggcttatcttctttagaaacaatatcaatgttcgctgtcgtatttcttgcagcagcagctccgtttgcacgaatattatatgctccggccggtactccatgaagatctgcaatctcttctaataattctttctgtattaaatccatgattctgtccccctaatctctgtttaatttctgacacatacttgatttgtaaaggagttccggaataacctcttctccttttccactcttttctacaagtccgtcattaattacaatgattctgtctgcaatttcaagaattctttcctgatgggaaatgatcaagatcgtaccgtctgtcttctcatgaagatcttcaaatacatgaataaggctgttaaagctccacagatcgattcctgcttctggttcatcgaatacggaaagctttgttgctctcgccttgatcatagcaatctctatacgtttaagctcaccgcctgaaagactgccattcagttctctgttaatataatctcttgcacataatcctacctgagaaagaatatcacagattccggcaatatctaatgtctttccagaggcaatgctcattaaatcttttacttttaatcctttaaactttacaggctgttggaaagcatagctaatccctttctttgctctttctgtaatattcaggtctgtaatgtcctcaccatctaataaaatcttaccggatgttggttttaagatgccggcgataatctttgcaagagtggactttccacttccatttggtcctgtaatcgcaacaaacttctcatcaaatgcaagattaatatctcttaaaatctctttatcatcatcatcaaccatatagctgatattttgtaattcaagcatagtttcctcctatcatctcctatgtactctcgagtcttttgtgcttgattttatgaaaagattccgagcgtacattcatcgtaacgtctaaattccatatataacatagagactttcaaaagtcaataaaacagcccctttttccctttgtttttttgtgcataccacactactttactaggatttacttagggtcgcagacagtggttttgtcaagtttctctgactttttcccaagccttacttcttccatatgttttgcatcctcttcttttgcataatccaaaagataatttcttttctcaccatgctgctgcccatttatctcccgaatctgcttttctgtccgttctacctcttcataaaaatctcttgcagaaatacggtatgcgccctgtcccataacaataacctgctctaaagcatccgaagtcgctactgtgaccttatactttctgccgatttcatgtgtcgtcttttcaatatactgatctgctgtttccgcttcttttgtatacacaacataaatattatggtatttctgcacttctccctgactgccttttactttatatgcatcaaaaacaagaatcaatgtacagcctgtaaatccctgatagttacttaaaatatccatcagcttatttcttgcagcatcaatgcttgctttggcaagttcatttaattcttcccaggcaaaaataacattatatccatctacaagtaaatattcttttttcggttcggtatcttttataacagttttccggggcattggtgccgacactgtctgtttacgataaccactgtaacgatctctttctttttgctttgagccaaactctctctccatgattgcaaggagttccggatcatctccatatcctgaagaataactactatttccaaaacgggcatttcctgttatcgtctgctcttcttctgatatctcatcagatccttctgataaaaaatcttcttttatatgcatatattccggtacttcgtcccattttacaagaaatccagcaccatgtgcgcagaaaacagaactggttggattatcaatatctctctcactgtcatatccaatctgttctatcacttcttctgcattatgacaaggttcatatccttttaaagtgaatgtgattcgcccacgtcctttcgtataagcccagacttcccgctgataatcacgcatttccgaagctggtgccgttccggtaagccgcaccattccctgcttatcctccgcctccggaccttcaaaacttccattcatctgtccgatatctgacatcgccctgcctacctgatcagacggaacttctaaaacaaaagagtaccatggttctagcaatatactttccgcagactttaagccctgtctgacagcccggtaagttgcctgacggaagtcaccgccctcggtatgtttcaaatgtgcccttcctgctacgattgttatcttcatatctgtaatcggtgagccggtaagcactcccggatgttctctttcctgcaaatgtgtcagaatcaggcgctgccagtttctatcaagaacatcctcactgcaatctgcatcaaaaacaagtccgctgccggtttcaagaggctccattttaagatgaacttctgcataatgacgaagtggttcgtaatgtccgactcccacaacaggattctttatcgtttccttgtatacaatctttcccgtaccaaactcaacatctaaatgaaaacgctccgcaatcattgtctttaaaatttctgtctgcacttctcccattaactgtacatgaatttcttctaatgcaggattccatacaatattaagaagtggttcttcctcctctaattgtttcaactctcggagaacctttgtcgtatccgctccatccggcaaaatcatctgatatgttaaaaccggttctaaaaacggggcagctgtacctttttccacaccaaatccctgtccgatataagaagaaaccagtcctgtaaccgcacagacacctccggcttccacctcatttactgtctcatactttgctccggaataaatacggatctgattcaccttttcttctttatccaccagattcaccggcatctttacaacaagctttccaccagttacttttaagaatgtgagacgttctcccttatcatctctggaaatcttaaatactttcgctccgaattcttctgttcccgtatacggctccatataccgttcaaacccataaagaagttcctgtactccctctaactttaatgctgaaccaaaataacatggaaatactcttctttcctttatcaagcgacagatttcttccttccggatactttcatgctccataaaatagtccagtaccttttcatcggtcattgccagctcttccagggtttctgcactctcttccttcccaaaggcaatgcatccttcatcaagacgttcctttaattctgaaagcaatgccgcttgatctgttccctgctgatccatcttattaataaaaataaatgtagggatatcataaagctttaacagcttccataaagtttccgtatgtccctgtacaccatctgctccgctgataacaagcaccgcataatcaagtacctgcagtgttcgttccatttccgcagaaaaatcaacatgtcccggtgtatctaaaaggttcacttttttatttccaagtgaaaaaacagcctgttttgaaaaaatcgtaattcctctgtctctctctaatgcatacgtatcaagaaaagcatctttgtgatcgactcgtccaagtttacgtaccgttcccgataaatacaacatactttccgataatgttgtctttccagcatctacatgcgccagtattcccattacaatattcttcacgtttttcacctcatttcaaaaatccaatatactaactgttacaccacataagaaaagcgacatgacttctatcttcaaagccctgccgctcttatattccttatcacctaacctctggtcatctaaaatgtattatcggaatctttttgtgcttgattttgtgagaagatttttgtcagttatgcccaaatttttgagacgtatgcggtgcgtacgttgatgaaattcgggtgcgactggcgggaaatcagccacaaaatcaagtgcaagaaagactctgagagtacattaaacggagatggagggatttgaaccctcgcgccggttatagccgacctaccgcatttcgagtgcggacccttcagccacttgggtacatctccaaagcacagcgacaattatatcatatggaagacgaaaatgcaaactcctgtaataggaaaatgtgaagataatcgcggcgtagaaaatgcgtcaccgcatttttacttgctccgacatcacattttcctattacaggagtttgcattttctgacttctataaattgatggtgtgggggggttcggtcagggagtttctgctatagctagctccttcaacggtcgtctgtttccaagcagactatctcagctccttgaggatttcgaaagcttccttcatggtatttttcacgaggtatgtttttttctcatattgtttacggtaaaattctacattttccctggaaggttcaaatacatttttcaggtgaatattccctgataaagcttcggtgatattgtctacatctcctactgcataggcaccaaacatgcagtttgtcataacggcaccggccgcattctctaatgtgactgtacgactgtctaacatatctgctttcatctggttccacatattatcacgacttccgccttctgtgatcgtgatgcggcttaagtcaattcccgcagaacgatacagatctgtgatctccatgtagtcataaccgattgcttctaaaacagcatgccataaggtcgcctgatctgtatccattgtcatgtttaagaaacatcctaccgcatccggaatatcattgattccacctgtcagatatggaaggaaaagtacaccatctgaacctgccggcacttttctggcatcttcttctaatactcgataataattatcgtcttctgcctttttacagatattatccttgaaccagcgtaatgcaagaccgccggtacggatatagccccagtaaaaatacgtatctggaagagaaccgctgttaaatacaagaccggatcctttcttgcttaattccggtataattccctttgtagatacacagaacatcgaacaggttcccgcaacatcaactgcctgtcctggcttcatatttccacttccgatcatggactgcatagtatctcctgcacctccacaaataggaattcctgccggaagtcctgtttcccgtgcaatttcttctgttaaatgtccgatgatatcccatggctttacgattcgtggcatcatttcttccggaataccgagaagatcaagctgttctttcgaccagcatttctcttctactttatatccaagtccccatccagacattgttccccagtcaataaacatatcttttgcagaaagacctgcaagatgtgccagtacataaggggcatcatgaataaacttcgcgccgttttctttaaatccttctatattctttaaaaaccagcgggcaaacatggcagggaacatacagtttgcttccggattacctgtttcttttccaaaaatgtctaaatcccagctatttacgagatctacatcatcctttgtacgtgaatcaagataattaatatatggtgtgatcgcattaccgtctttatctacaccgcagataccacagataataccatctcccataatcgacttaatctttgtcacatccagccctttttccttcatcaaagaagcacattccttcattcctttaatcgtgagtgccagatactcatccacgtccatacttacccatcccggctccggataagttaatgttgttggtgcggaagaagatacgatacaattcatattctcatcatataccgctacttttacactctgtgttcctgcatcaaatccaagataatactgactcatttttcaattcctccattcttttactatgtactctcagaatctttttgtccttgattttacaaaaagctctgaaaatacattacgaaaaacacaatacattctctccaaataataaagtttgaacagggaaggaaactttagcttttttaacccataaaaaataccccgatagaaatattatcggggttaagctacacttttaaacggattcatatgatattatgcatcaaattttgtatcagagtcctcatcatgtaattctatccttgattctatcctttacctgatgcttcattcaacacaataaaaatactataaaaaccgctctcttctcattcttctctcatccagactgtactgtcggcttcggactctcaccgaatcatgccaatggctcgcgggcttatgttaccagattcgttcgctcataaatagctgcttcatctgaaacaaataccgccggtagggaattacacccatccccgaagattctgtatttatttactcgtttattataacgcattatgaatatggattcaagataaaaataatggaaaaattttatatttctattcaagatatatcgtagatgtaggagtcatcttacatccgatatatcctacacatattcaatatgtaaataaaacatttgatgtcagaacttttcctttctatacttaagccatacgaaaggaaagccaggtgttattatgcaaactgttttaccaagagaggaagaagttgaagctattttttcccagattcttgcttctccggattcctgcaaaaaattaatggatgttttttatgatgcaatggatgataatcatttattagaatcggatgatccgaaacatttttccaaagtactcttttatgcctatcaaaacggtgatgtcaccgctcttttattaaaactttgcggaaaaagtatgtttgatcttttaagagatgcgtacctgattcctaaaaaatttcatggaaaagccggaatgaatcctgttcttttaacaaatcctgacggagagcttttgcctacagcaaagaaaatcgtttccagtagagagtatagtaaatttaaagaaatttataagaatcatgaatgtgcgcctcgttctaaactttatcttgccgatggatatgatatcgttcgttcctatgttggcgataacgagatgaatattacggagaaaaaagaaaataaacgacgtggtattatgattctttatgcacttcctgatacgaaaaagttaggtttaactgaagcacaggcttacgctgttgtatggaataccttccataatatccaaaaagaagctcctcatgcgatcgtttattacggacaggaaaccggattaaaaaaagcacagacttttgatgaaatcggtattcttcttcctattcgtgaatttgaaaagaaaatgttacaccatttgagtgaggtagacggacttgttttaacctgtcgtgaaaaaatgatcaaaaaagccggagtaaaaagtcttgaactgtaacgaaatctataaagaactgtaaagggaagtgttaaaatgagtcagtcaacaatacgaaaaaatcacatggatgttctctggcatgaatatactgacaataatggagaaaatattccggtcacacaggcaagtcttacagaaaaggcttctattatcggcagagtaggtatcatgctcttatcctgtggaaccggtgcatggcgtgtacgaagttctatgaatacgcttgctgagacgatgggtgtcacctgtacagcggatattgggctaatgtcaattgagtatacctgttttgatggagaagaaggttttacacaatctctttgtttaacaaataccggagtcaatacttcaaagttaaatcgtttggaacattttatccgaaactttgaaaccgaaggaaagattatgtctggaaatcaactgcacgattttctcgatagtatcgaagaaattcatggtctttattctccggttgctcttggtattgctgctgctatcgcctgtggcggatttacttttttgcttggcggcggactgattgaaatgttctgcgcttttattggtgccggtcttggaaactttttaagatgcaaattaaccaaacatcattatactttatttcttggcattgttttatccgtatctttcgcctgtctttcctatgctggacttttaaagcttggggaagtctttctccatctttctgtgcggcatgaagccggatatatctgtgccatgttatttatcattccgggatttccttttatcaccagcggtattgaccttgcaaaactggatatgcgttccggtattgaacgactcggttatgctctgatcattattttagttgcaacaatgtctgcctggattatggctttgattctccatcttcagccggttgactttctaaaaatctcattaccattatctggttggatcttgttccggcttcttgcaagtttttgcggtgtatttggtttctccattatgttcaacagtcctgttccgctggcagtaaccgccgcattgatcggtgctattgcaaatacactgcgtcttgaacttgttgatctgataaactttcctcctgctgctgccgcgtttatcggcgctttgaccgcaggtcttcttgcctctttgataaaaaataaagctggatatccaagaatctctgtcactgttccttcaatcgttattatggttccgggactttatctttacagaggattctacaaccttggtattatgtcccttgctacttctgcgacctggtttgcttctgcaattttaatcattctggctctaccgcttggattgatttttgccagaatacttacagacaaaacatttcggtattgtacctgatcggatcgcactatatttttctgcttctatttctattgttccttacatagagcatcgccatcgctgctgctgcaatcccccaggatatcggataagataatgctactttatccggggaaggattctttgccataagcgcaaataatgcaataattcggaagccgcagaaactgatcaccgttacgatcattggcagaaaggcctttccaaagcctcttaaattactgctgaagcattcaagaacggtgtaaaaaaagtaaaatggaaaggttacttttacgatttctaatgtctgcgctgctactgcagcatcttttgtaaatacatttaaaatcaccggcatcgctatgataagcagtatacaggcagcaaatgtaataagagatcctccaaaaatacaaagtctgttaccctttttgattctttcccagttgccggctccgtagttttgtccaataaaggaaacaaccgcctgtccaagtgcgacaattggcaggtagataattaactccactctgaaatagactgtaaacgatgctactgaagtaacacctaatgtattaatctgtgactgtatgataatattggacaaggtgataataattgactgcaccccagccggcacacctacttttagtatatccgtaaattctttcaggctgcaatctgaaaaacgaatccgcagtgcatacggttcttttaatcgatataaatggatcatgactccgatagccgcaaacgtctgggaaaataacgttgcaaacgctgttccttctactcccatatggaaaacatataaaaatataaaatccgcaaaaacattaatgatcccgccaaaaaactgatatagcatcggtgttctggaatcgccaagtgctcttagtacaccgcttaaaagattataactgactacagatatcatactagccatataaatacggaggtatcgcaccgctagtggaaaaatactctccggcgtacccatccaggttaaaaataccggagataagaccagaccgatcactgttaaaaagaagcctccgattattcccgtccaaaagatcgtctgtatcagtttctttaattgttcaaagcgtcttgctccataatgtcttgccgcaaagacattcgtccctacagccattccgttaaaaaatccaatcagacaggttacgatcagaccactggctccaatcgccgccgatgctttcgtcccaagaagctgtccaacaaaaataagatctactgtactgtaaagctgctgaataagactcgaacccaaaaggggaagagcaaataaaagtatgcccttccctacgctgcctttagttaaagtatggctgttatttttcaaatcatatcctcccacatctcacgagaatgaattccggcatgatcgtcataatgttctttacgatgtttatgaagttcatcatgtgtatgctggtgtgtatttcccatatcatcaatacagatatcgtaatgtccatatgcaattaatggagaattctccggaacagaataagaaattgtctgatacagaatgattgcgtcttcttttaaacgaaattcttcgatgacatttccaaaataatcttttaattctcctaaaagctcaccggctttcacaatctggcctgctttctttttcgggaaccagcagccagccttttccgaatcaacataatgtgcatgattcatatgttttggtacacgcatctgcatttctgctaacgttggtcttgtctttaacataccgatacggcgaagaatattctttacatctttctgtgaggctgctacttcctcttctgaccacataccattacatccacgctcgatcagtaccgatggaattcccaacgttccggcataattatatgctccgccttttccactttgtgacttcacataaaatggcatatctgctgcctgtgccattctttctgcttccgctacggtctcctccgaagcgttaccgacacaataaataaatggtgttaaatcctcaaaccaatctccattatgtacatcgatataataatctatttttgaaaaaatctctttttctataaaatatgccagcttatccgtatacgttccattcgcatcccccggaaatacccggttgagattctttccatcttccgcagaaacactgaccgtccttgctttaaatccatttacattgacaatatgaagcaggataagaattcctttaatgtcttcaggctgaagctttgctgccagtcctgtgacacactcaattcctacatattctgcattgtgaattcctccgtctactaaaaccgtatgtccttcttcctgtccatagattaatgttacgggtaattcatcctctgtaaatggcagctttaaaaatccacataccttttcacccttttctacataaagattgcctaactgaaatcccataaacttctacataacctcctttaacaatactgtatctcaaaatgattcccatccataaagagtattccgtatattcaaacaaagaaaaagagacctatactcactataagcctcttcatctatcgtattctaaattttcaatcataaatcatctaataaatttgaaacccaattccatcgcaaatcatatagtagatttatgtgcgagatgcacagctctcttaaaattccgtaagatgagtcgactaaacatataagcagttctcctggcttggttctccatcggtacacccttcccaaaatataatatctcagtggcttattgtacagactccccttacagtgacggattcgctccggactctcaccggattctcttttcatcccttcggaacttatatgctatgtatctaattctcatctattgtaacataggctttttcagctagcaactgtatcttagggtaaaagttagttattacttactctaattagttctaaaaatttatcatgaattctgtcatttccagttaattccggatgaaatgagaatgccaactgatttttgtaagcgacacccacaattttttcctctacctgtgcaaggatttccacatttttttcgacagattcaatatacggagcgcggataaattccataggaaatgttccgattcctttaatctctccctcataatagaagcttccaagctgccttccgtatgcatttctctttacagtaaccggtaacgtagcaaagcagcgattcttatcgtttgaaatattctgcgccagtaaaataagaccggcacaggtagccaaaaccggaagaccttcttctatttttttctttaaagtttcaaacatagaaagttcttttaaaagtctgctctgtacagtactttctccgcccggcagaacaagaccatcaaaatcctgttctaaatcttctgcctttctaagctctactgtctccacaccaagtctttctaatgctttttcatgttctataaaggccccctggaccgcaagtaccgcaactttcatttttgttttcctctctttattttcctctctctgccattaataattgaatctcactctcgttaatgccgaccatcgcttctcctaaatcagcagaaagctctgcaagcattttggcatctttataatttgtaaccgcttttacaatcgcatctgctctcttctttggattaccggatttaaaaataccagaaccaacgaatactccctctgcacctagctgcatcatcaatgccgcatctgctggagttgcaactccaccggctgcaaagttaacgactggaagtcttcctgtatcgtgtacttttaacactaattcataaggaactcttaactcttttgctacttcaaaaagttcatcctgtctcatagaagtaatgcgtgcgatctcacgattcatcatacgcatatgacgtactgcctgtacaacatcaccagttccaggctctccttttgtacggatcatagaagcaccttcattgattcttctgagtgcttctcctaaatcttttgctccacatacaaatggtactttaaactgtttcttatcaatatgataaacatcatctgccggagaaagaacttcactctcatcaatataatcaatctcgattgcttcaagaatctgtgcctctgcaaaatgtccaatacggcactttgccataaccggaatagaaactgcttcttgaataccgcgaatcatctttggatcactcattcttgataccccgccggctgcacgaatatccgccggaattctctctaacgccataaccgcacatgctccagcttcttctgcaatctttgcctgctctggagtagtaacatccatgatgacaccaccttttaacatctgagcaagttctttatttaattcatattgtttttctgcattattattcatgataaactcctttcattttcccgataaaacattgcctttttcatttgcatctgcccgtatagtacagcaaaaatgaccatattgaaatattcaatttagatatagtcaatatggtcactttgtttctttttgaagtttattttgctttttattcgcttttcctatcggtttaatatagtcagtttaaaatgtcactgtaattgtagtcccttttccaacttcgctttgaagatcgagttttgcatcatgaagtgcaacgatatgttttacgatggcaagccctaaaccggttcctccagtctgttttgaacggcttttatctacgcggtagaatcgttcaaaaattcttttctgatgttcttttggaataccgattccagtatcttctactctcaaatatgaatgaccttgttcactgtctactctgacctttactgttccgttctttttattatagcgaatggcattggcacaaagattattgatcagctcgtttatcatctcccgatttgcagtgatttcctgcggaccaccttcatatgtaatagtcacatcatttttttccgcataaatctgcatattttctacacagaatgctgcttcttcaaaaaggtcaaacttttctacaatgagctgggtgttcgcactatctaattcagaaagacggataatatcattgatgagcgaaaggagacggcgggcgcttttttcgattttctggcagaaagttccaatttcttctgaaggaaccatgccattttccataagttccgcataaccggatatcgcggtaagtggcgtttttaattcatgggacacatttgccgtaaagtcctgccgcattctggcactttttaaaatatccgtatgttgtgcccgaatcgttgccgcaaatggctctaattccttataagctggaataacagaaaaatcgtctaaatctactgccatctgctcgattggttttataatgtttttcgtcataatgtgtgccagaataatacataaaatcatcataataagaatcgtagccgctacgatgggaagtatctttccgcatacgctccatatattgcttgcttctctggctactcgaagtatcgaaccatcatttaactttatggcataataaaaagtgtttgtatccatcgtcgcagatttccggacagcatttccatctccgtctttaaatgcatgtttcacttcaggacgactcatatggttatccattgttcctacatctgcatcattatcataaaggactgttcctgttgcagagatccacgtaactcgaagtttcctgtaatccatatgtaatgcattttcatttccagaatgaaaaattcctgtatttttcaatacaatggcattggctcttaagtcatcctgcacctgtgtctgaaataaatcataaaatacaaacagcatgaccagcatagtagcaacaatcgcaatcagcgaaatacttaccagttgtacattaatctttcttctcatgatacttcccctgtttcttttttattccattacatatcccacattacgcactgtcttgatatgtttactgctatcgcccagctttttacgaagagtcttgatatgcatatcaacggttcgggattccccttcaaattctgtatcccatacacgttccataatcatttctcttgacaaaacgattcccgcattacgcatgagcagttttaaaagttcatattctttataagtaagctcaattcctttattgtctacataaaccatatgacgctcattatcaaggaagatttctccaatcgtcatatatttgtcatccggctgttctacagtacggcgaagaacggcctttattcttgtaataaattcaataatggaaaatggtttttttatgtaatcgtctgctccgatatctaatccctttaccatatcaatttccgatgtctttgcagttaccataataaccggcagcttttttgttgctggatttttacgaagcttttttacaatttcatatccattttcatctggcagcataatatcaaggattgccagatcagggagtttttcttctatttttttataaaaatgtttggcatcttcaaactgttccacgttatgaccgctgttttttaatgcgattgcttctatttcctgaatgtttgtatcatcttctactatataaatatttgccattcttattttcctccataattattttccactatcttttcttgcctccatcttttctgtctttgctatcttttctttcttgccagtatgtttactttccggtaaagcatacctttcactaagctccatatattcatgttgaaattcttcgctgttttcttctttt

SEQ ID NO: 456 - DNA, 17206 bp, Eubacterium hallii
gtatttaagatgcggacgagtatcttaaatatagcgactacagagcagatgggatatggtattctttcttttttcgtctacatcaaatctacaaatcagaagttgtgtattcttttttcttctgttaaaatggacataacttaagttatttattaatttatttggaggtaaaatatggaaacaacccagaataaaattgtaaaagcagctttgttaggtgctggtactgttggtagtggtgtatacgaactagttaaggaacgccagaaagatttcccatatatctgtggcacacagatcgagattgcaaaaattcttgttcgtgatgcttctaaagaaagagagggaatcccatctgatcttcttactgatagctgggaagagatcatcgctgatgacagcatctctattattatagaagtaatgggtggaatcgaacccgcaaagtcctatcttcttaaagcgatgaaggcaggaaaacaagtcgtaactgccaataaagatttaattgctgagcatggtcatgaacttttagatacagcggaaaaatatggctgtgattttaagtttgaagctgctgttgccggatgtgttccaatcattcaagtattaaaacagagtatgtccagtgaaaatattactgaaatcatggggattgtaaacggtacaacaaattatattcttacccgcatgacgcagagtggcatgagttatgacgaagccctaaaagaagcaaccgatcttggttatgcagaagcagatcctactgctgatgtagatggtcttgatgccggacgtaagattgctattatggcttcgattgccttccattcacgtgttacattttctgatgtctacatcgaaggaattagaaacattactgcaaaggatattttttatgcaaaagaatttaattcagtaattaagcttgtcggtattgccagaaaagatgagaacggtatcgaagtaaaagttcttccgattctcatcccacaagagcatcctcttgctacagtaaatgattcttttaatgcggtatttgttcatggaactgcttctgatgatacaatgtactacggtcgtggagccggcaaacgtccaactgccagtgcggtaactggagatttatgtaccgttgcaagacatattattgaaaaacattcaaatcttcatgtatgctcttgctataaagaacttccgattaaaaatatccaggatacttactcccgtttcttccttcgtatgcaggttgctgaccgcccaggtgtcctcgcaaatattacaagtgtatttggtacaagccaggtaagtattgctcagattattcagaaatcacgccaaaacggaattgccgaactagttattattaccgatagagtaaaagaactctatttttccgatgctcttaatattttgaaaagactttccattgttaacagtatttccagtcttattcgggtatattaaggatattttacattcttttctcgtaaataccttcaaatacccgttgacaaattaattgaaattattaaaatagaatggtaatgctaattttaaaccacggaaataggaggatttattactatgcgaaaaaccaagattatttgtacccttggaccggcaacagataaggggaatgttctggaacagttaatgctttccggaatgaatgttgcccgccttaatttttctcatgatacttacgagaatcagaagaaaagaatagataaagtaaaagccttacgtacaaagcatcaccttccggttgcatgccttttagatacaaaaggaccagaaatccgtttaaagacatttaaagaggaaagagttactcttgaaatgggacaggatttctgcctgactacaagagatgtagaaggaacaaaagacatcgtcagtgtcacacataaagatttgcacaaagatatccatgttggttctaatatcttaatcgatgatggactggttggattaaaggtagtggctatcaaggggcaagatatccactgtaaagtagaaaatggcggaacgatttctaacagaaagggagtaaatatccctggtgtggaactttctatcccatttatgagtgaaaaagataaagaagaccttttatttggtatcaaacaggatgttgacttcgttgctgcttctttcacaagaactgctgatgatatcaaagaaatgaaagcattcttaaaagcaaatggcggagaagatatccgtattatcgctaaaatcgaaaactctcagggtgttgataatatcgattctatcattgatgcctgtgaaggtatcatggttgctcgtggtgacatgggtgtagagattcctgaagaagaagttcctattatccagaagatgattatcaaaaaagtaatcgcagctggtaaagtagttatcacagctacgcagatgctcgattctatgatgaaaaatcctcgtcctactcgtgcagagactacagacgttgcaaatgcaatctatgatggaacaagcgctatcatgctttccggagaaacagcagcaggtgcttatcctgtagaagctgttaagatgatggctaaaattgcgaaacgtacagaagaagccatcaattatcgtaaacgttttgatgatatggctaaatacacaaatcctggtatcacagatgccatctgtcatgctacatgtagcacagcttatgaccttgatgccaaagcaatcatcactgtaaccaaaactggtttctctgcaagaatgattgcaaaataccgcccaggttgtgatattatcggatgtgctatggacgaaaaagtctgccgtcagttaaacttatcctggggtgtacagcctatccttcttggagaggaatgggaagtattcgtactctttgagcgtgcaatcaatgcatgtaaaaaagaaggtctccttgaaaacggtgacattactgttattacttccggtgtgccaatcggacgctctggaacaacaaatatgttaaaagttcaggtagtagctgattaaatactatttgtagatttcgtgtagacgaaaaaagaaataataccatatcccatctgctctgtagtcgctgtgtttaaaatgcttgttcgcatcttaaacacgctccgaagccgcatctgggatatggtattatttcttttttctgcgttttggcttcacatggaatgaatgcaatagtctttggagagatgggggagaaatcgaagattactgctttctcggaagctctatcatcccgaagattattttctttaacgagtgggataaaaacgccggagcattcactaatttgctatttgttatcaaaaccagacagtcgctgaaacaaaactttatgctgaattgtaagaagactatgataaagaaaaaagaatggttataagtattgcattttgtgactttgcgctatggaattctgaccataggaacttgggactcgtttttcccaagttcctgtttttctggacagaatggaatgcttagcgcaatggaacaaaatctaacttataaccattcttttttctttagaagactgagtagaattcagcaagaagatactccttttagacaatcccctcttcctcaaatccaaatactaatttccctctggagccaaagaacagaaaaccaaaaatttgaaatagaagaaaaagtgatgtcggagccagtaaaaatgccgaacaggcattttctgcgccgcgactatcttcacattttcttctatttcaaatttctggttttcgtctctttagtgcatcaaattcgtatttatcttttctttgtttagtttttctcctattactatgaagatttcctgtcctttttttatcggttgtatagtaatattttgatgtgtggcattaagttcgatccactgatctggttttgtctgcataaatccttttattcggaagatattcccacattctttgtcgttaaatatttgttttactttttcttcaagtttcgctaccggcatagttaaattcataaaatataatgactgaaatgcatcttcttctgcaatgtcttttttctcataatctgcaccaacatagcctgctgactgaattcttttaaaatctgcatcagaaagtttattccaatctttggcaaagatttctttttcaaatcggcggtcgcaatggacagattccattgctttattaaggtgtgcttttgtgcgttctatatcggtctctgctgcctcctgcgctttacttaataaaacaatgcctgcattggctacttccgatgcaaggatgaattctgcgtcttctgagagattctcttcaagcattgcatctacgactgtaattacatttcctatttcataccatctgtcaagcggagattcatgaagggcatcgaaaaattcgtccatatcaaaaattccggacggctcaatcaacactctgtcatatccgcacattcccattgcaataagttttgtgcgaaatcttcttctatgacaatctttatcgcatccacctgctaccatttccaatgtacatttttctcctgcaatgtcctgaagtaacatcatatcgacatttactgccccaaaatcattctctaatataccgatatttaatccctgatctataagatactttgcatatttttttataaatgtggtcttacccgaacctaagaatcctgtaattaaatctatttttaccattttatttttcctcctgttttggcaaggatattataacaaaaaaatgattttgattctatgccaaaatacatagatcaaaatcatttttataaatatacttatgttttatttttgtcttatcaaatgttttataaccttttctttaaaaaattgtatcatcggtccattgcaacatgcattgattatcgttccgattcctacaatactccacacgctgtttttacctataatgcaaaacagcaccccgatcatcactactgtaatatctgaacttactcttgcaatatgaaatggaatttttccttttgttgctttttcaataataatagccaccgcatcatatggggcaactcccatgtctgctgtcatatacaatgctactcccattgatgccatgaattgcccaagtattaatgcaataatacgaagcagcattgttatatgtatctgtgcaacgtcgtttaccaggaaacaaataaagtctgcaatatatcctacaaataccatattgatgattgtccctaaccctatgcaatgccgcaccgtaaaaaatacaataattagtaatacgatatttataacaagttgccagttaccaaatgaccatccaataaatccactaattgcaagattcattccgctaaatggatcgacaccaaagcctgcaattcgaaggaaagacacgcacagaccgatcaataaaatacctattaccatcaacagaattcttgttttagattctatctgattttctttttgcataacatactaccctttttatttttcttttgcctttaaagtataaattcttgattcaaaatctgtacatggagttgcatcacccggaacttctcctgccgttacatctgttgtaatcagaccaaaattcatcagttcatctccataattttctgttttatttaaaatattttcgtaaagcatatctggatctaatccttgtaattttattctactatatgcctgattcactccatttaatgtacgataatatccaacaattgctgtctttttatcttcactcacaaccatccaaatcgtctcatttccttcaaacggactttttagtctgtaaaaatcaccaaactgaaataattttctatattttttcataaaaataatctgttcttttacttctgcgatttcttcttctttcagactatttaaatcaagttcatagccaaaagtaccaaaataagctacatttgctctggtatgtaacggggtttttcggaatacctggtgattcggaatgaccgacacatgacttcccatactgcttatcggataacaaagagaggttccgtattgaattttcaaacgttcaattgcatcggaatcatcacttgtccatccctggggtgcataatacaacattccggggtcaaaacgtccaccaccgcttgaacatgattcaaaaagtacttccggaaattctgatgtcagtctctcatataagtcatatacgccaagaatataacgatggaatacttctccctgacgatctgccggcagtgccacactgtaacattctgtaatactacggttcatatcccatttaatataagaaacttttgcttcagataaaatctttgccatcatctcataaatatactctactacttctttgcgtgaaaaatctaaaacatactgatatctgccatgagatgcatttcttcccggtgtatgcaaaatccaatctggatgcgcacgatacaagtcagaatctctattggtcatttccggttcaaaccacagtccgaatttaattcccatcgcttcaattcgctctgataatcctttaataccattcggaagtctttctggatttgcaacccaatcacctaaacctgcatggtcatcatttctttgtccaaaccatccatcatctaatacaaaaagctctactccacattcttttgctttagaagcaatttgaacaagacgatcttctgtaaaattaaaataagttgcttcccaattattatttaaaattggtcttggacggtcccgccaataacctctggcaagtctttttgcatacaaacgatgaaaagtctgactcatcttatttaacccttgatcagaatagaccataaccgcttccggagtttgaaattcttcccctggttctaatttccagtcaaatcgatctggattaattcctacagtaatccttgttacatcatgggtatctacttctgcctgcattcggaaatttccactgtagattaaactaaatccaataacctctcccgatgtttctcctgcattcggacgtttcagtaccataaatggattgtgttcatgcgaagaatttcctcgcatactgtctattgcagtaatgccctgctctaatatacgattctttacatatcgttctctagaccatgccccggaaagctgcatccacacataatccttgtccggaagatctaaattaagactcatcatcgtctgcaaatgtaatactttttctccttcattacatatatgtgcgcttctggctattgcacttcctttagaaaaaatagtatataataatgtaagttttgctcctgtcagactatcttttaatataatttttaatgtttctgcctcttcctcactttctgtataagttgccggaagtccttttaacgatggttttccctttaaaatctcataacctacatactgaaattcagaaatattacttccattttcctgcataatttcaattgccggatgtcgataatctgttgttccatagacaggatattcttgtcttatatgctctaaagaaaagctgcggtctccctcaaaaatgtaagaagtcatcggacgaccacatttttctacaagataggagaaatctggtttgtcatgaattctttttccataatataattgtcccatatgtccgttttctaagacacacataatatagctgatttcttcgttatataaatgaaatgtttttgtttctttgtgaaaaataattttttccataaatgattctcctgcctctctttttattccgtcactatttctctctgtgcatgaatttcatttactttctctgttacttcttccattgcggcaccttttaacttatagcatttcttataaattaagaaactaactactgcaaggataaccggaatgacaatcataagtacacgtatacctaaaatagttcctgcactctgcaccgttgcttttgcattatatcctacaacctgaagtcctactccgcttaagcctccagctgctgctgttgctgctttcatcaaaaatgtctgtgctgaacaggtaacactttcatttcgaactccaaattttacttctccataatcgataacatctgccatacagcatgttgtaactcctaaggaaagtcctgaaccaaagaataataacgcacaacagattacaacaagtactgcactttttggtgcaatgaatcctgcgattccaagtaaaataaatcctgcaattggaagcgcacacgcatatgcatatactttttcacgactaatctttgttgaaatcttagggaaacataccaagccggccatttcagcaataatggcaaatccaaaaatagaatataaatattcatttccacatacgcacttgaaataataaacggcgaaactttttgcaatctgtgtacaaaggttaaatgtaagtaaaattccaataaaagcaagtaactgatcatttttaataatgatacggaaagcctgttttaaacttgttttctctgcgtaaactccgattgttgattcttcttttacgttaaatacagtaataccgattgctacgataaaaataactgcaataattatcgcaaataatgtatatcctgtttctgcatagagatttttctccccagctattttatttaaatgattaatgatatacagtccaaatgttgctactgagaatcctgcaagacttgcaaaaaatcttggaataacagatactctctcccgctcatgtggatcatttgttaagtttggaagccatgaccaatatggtacatccataatcgtatatgtcattccataaagtatatacattaccgatacataaatatataatgaagtgcctgataaatgaaagctatggaacaatagtacgaatacaacagaatttagtaatgttccaataacaagccatattctgaactttccaaactttgtatgtgtattatcacagatcattcccattacgggatcattaatcgcatcccatattcttgccaccagaaacagcacaccaacaaaagctggtgctaaatataaggtatctgtaaaatataacattaaaaaagagccaaccagattacaaatggcatctttacctatcgcaccgataccaaaacaatatttttctcttgtagacgcatatttatactgcggatgtttatttgtacttttttgattactcatccttttcctcctccagaacaatctatctcttaatttaattatttttctgaggaattttgcgcgcttgttcctaactgattacagtataacccaaaaaaataacacccgttagcacattttgtttgtaaaaccattcaaaatgttgtctatcgggtgttgtttatatcattttatatgtaaattatttctatctatgatttataactatctttaacaactacaaatattttgtctttttgtctccatattcctccagttctttttgtacacgtaataaacgttcctttgttgtctttctgttttctttgcgatatttacttggtgtacctcccgtttcctgtttaaatgctttttcaaaatttaaagcacttttatatccacaagaatgtgcgatatattcaattgaaaagtccgttaatgttagttgttccttcgctcttgaaatacgaaacttcgtcaaaaaagctttcggagagatatttagactttttttaaaaacagtatacagataacttcggttcaaagccagataatccgctatatcatttaccgtaatcccctgcgaataattattcttgatataatcaattgcctcctgaacatgcatactttccgttgtatcatcttcaaactgcctcaatgtaatttctcttgcaagaaccgaaaaaaaatcgaacaatcttccctgtaaataatataaattctctgttgttgattttgtatgtttcaacatggaaaatactatttctttaagttcttctcctccttcacactgacagactaactgtctgctgttcaatccaacatcctgaataaaactctttgcttctgttcctccaaatccaacccataaatatgcccatggttcctctttatcagcctgataaaatgtcaggctctctggttcaattaaaaatatctgtcctttggaaatatggtacttcttttctccaacctgatatatcccctttcctcccattacataatgaataatataatttggccttgttgccggtccataactatgcagaggttcacactccgcatacccacaaaacaacaaatgaaactctttaaacttcggttctaaaagctgtaatacataagcatcttccatacgatttctccatccccaattacttctctaatcccaatagaggttatcatgcattgcatgatgcgtatctcacaataagaatgacgaagtattctttaatacttataatttatgacaaaatatttctaatgtcaaaagatttttaatcataactcttctataatacttctctataatacttcgtaaaacgtctcatgctttgtaaatatatttcatttacaattctgaacttttatgggattttacttaattgccataagataaatattgaaatttccgcgaactctagtgtataattataaagtttaatgatgctatgtactttgggagtcttcacatccttacttttgtgagaagagtctgtgagtacattatgaaaaacaggaggttttacaacatgcttcgtgatgattttgacttacgcttaacaaatgaattaatagaaacttatcttaaaattgcctatggaatcaaaccgggatgctggcttgatgctgaaaaaggtcttcttcaggaaaatacactctatcctaagttaaagcaaatgatcaacgatggcaatattaatgatgcagaagatattctctatgaatatgctaatccaattaatccggacatattaaaagtcggtctgttcttctactatgatctaaaccgtatggctgatgctgaacttgaagcggcagacttcactcgtgatgaagtaaaagaaggcgtacaggaattacttaaaatttacgatcaggaaaactttggaacaatttttcgttagaaatctggttctttcaggattaatcctgcatttctgacatgtgctttctataccagagcggtataagattgcgctgacatacgggattcttacgttctttaatcccaatcgtctgaaagaatgttttccacagtgcagtcatactatcggtatcctttgctgcagattctcttgccaggaattctgacatttcttcttcggaaagagatgtcagataatatggctggtctgccggatgtaccactgctgttcttctgttatcatctatgatcatccagtcttcagaaggtaatctatccacaaaatgtggtgcaagtaaggtaataacatcacatctaggagaaattatccccacaagtatgtgatgatccatctcggtaaaccgaatacattccctaaatatatgtgcttcattacttgcttttcgttctagctcaaatattttcattacgatcggattctgtagtgaatctagaatctgccttccataatgaaatcccaatattaaaaaacgatagatgctatcaagcttctcctcttcatccgctgccatcgctgcatgatataccatctgatatgcacgaaaggaaatcttttgttgaatcgttcttatcacactctctgttttctctttatctgcctccacatgacggtattcacaaaaaagttccattgttccaagctgctctgttcttaactttatattattatgtccaagatgggatgcccacgcttcgtaaatacaggtcatcatatcatcaaatctatctttacatgtaaaaattaccatatcatttctgctttctttaggtgccggggagttcacgtcaaattaaaatcatcaaataaagatagctgtctgtatgttgttggatgctctatcttccagttatctttctgattcgtcccaataagctgacgggtaataaagtcctcttctatcggtgtatgatacttcatcttacctcgacaggttataaaataaactgcccgctttaatacaactcccatcttcttgatatcttcaaaatcaagtgtcgcctgtcttcttgccctgacaattcgccctgcggacttattccctattcctggaacgcgaagcaactgttcatagcttgcctgattgatttctacagggaagtattctaaatgtcgtaatgcccagtcacactttggatccacaaacgtattaaaattcggccgttccgaacttaggagctcatccgcctgaaatccatagtaccgaagtagccagtctgcctgatataaacgatgttcccgtaaaagaggtggtacggttccaattgctggaagttccggatcatcattcaatggcacatacgctgaataaaaaaccctcttcatgtcatactgctggtatagctgctgtgtcagtgataacaaatgaaaatcactctcacctgatgcccctataatcatctgggtactctgtcccgccggaacaaagcgagattgtgttctctttcctatattctgtaaaaaattagacggtaaaaaatctttatcaggcaaattatctttattattccctatattattctccatattggtttcatttttctgtataccttccatgagggaaacaacggacttcccatgaataccggaaacattcttctcattaaatatgctattcgacaaatattgattccccttcgccctctccattcggctatccttaccaagtgctactctctgcgtctgtatccctctctgaatctgctgaatcggccgaatcagattctttggcttcttattcggtgccagtctcttcaagccttcggcagtaggtaattccagattcacactcattctgtctactaaaaatccaagtgcatatataatatcatccggtgcccctggtatcgccttcacgtgaatataaccattaaaatgatacttattccgaagcatataaatcgcctcatacattcgctccatcgtatatgccggactcttcaccaccgcagaacttaaaaacagcccctcaatataattccgacgataaaactccaccacaagcctgcaaatctcttccggggtaaatgttgctctttccttctcgttcgcagcacgactcggacaatacttgcagtcaaaaacacaatcattactaaaaagaatcttcaaaagagaaacacaccgcccatctaaagaaaatgtatgacagatacccgcagataccgtattcccaagatgccccttcttccctcttcgacttgatccactcgaagtacacgcaacatcatacttcgctgcatctgctaaaatctttaactttctctccagagaaatctctgtttctgtcatagtatcacctctttataaacatatgttccgaatatttgtttgtgtatattctaacacagctctcctacaaaatcaagaactactgatttgtagatttggtatagacgaaaaaagaaaaactaccctaaatccacagttagtgagaatggggattctccagaaggttaaggattatcggggaattaaatgctaaaggattgacattcaaattgttgtatgtgactgaattgtatttaatcttcttttctttactatactttccttacaattcagcaaaaagttctattacagcagctgtctaacctctttctacaaattagttaaaaaataagagagagggctttggccagaaatctacgattgttgttcagataaaatttccagaagaaatgcgtcaatcctgtagaatttaatttcctggaaagtcatatccttctggtacattccacgttgcccaactagtggatttagcatagtcagaaaaaagaaaaaaataatacatcccatctgctctgtctagccggcgaatctgccttgttgcttcgtagcctcccataaccggcatcataatatccatcaggataagatcatagctgcccgcaggatgtgtagaaaatgcttctactgctttttgtccattatttacacaaaagactttggctccttcttcttctaaaagaattcttgcaacttcctgatttagttcattatcttctgcgagaagaatttttatatcttgaatagattctctttctgttttttctataaccgttgtctttaactcctgtgcccgttcaaaaggaagtgtgataacgaaggtgcttccttctcccagcttactgaaaacttcaagatttcctcccatctgttcaaataatgcttttgcaatactcatttccagactggttccctgataaacacttcttacatctgttccttcctgtgtaaacggttcaaatatcctacttagatagtcttcactgataccaattcctgtatcgctgattgtccactgatatgtaagtattttttcatctgaatgaagaagtctgacatgggttcgaatctctccattctctttattatactttatacagttgctgtagatattcatcattgcccggattaaatgtaatggacttccataaatataaggattctcataaacttccggctcgatctccattactgtagtaagtccctgttcttgtgcctgcataccaataatcgtatactcttcgtcaatactgtaataccccgatgaatgtgtgttcatatccccgcacctttcttttcattcttcataactatttacagtatagcattactttactatatccactacttttttcagcaaaactgtaagagaatacgtttttacatttattttacgtttatttctctaaagtttgctagagaaatatcgtgatatggcgtatactaaaaatgtatgtgtaataacaagtcttctatagattacatatactaatgaatatgaacgtaaacgactcctaccactatcttattcatatattttaaaatacattttaattcaagaataccccactgatgctgatttgttgctcgccacctacagaggtgggagccatctcacatctgatataaaaaatgatttataaaaaagaaagaagggaaacgattcattgaaaagaaagaaggtaaaatccataaaacaactggggaatacggggacacagttagaaaaagaagtcgctgcgatggaagaagctatgaagcagcataacatagaagagaattgtcagaaacttattgatgggctgatgccacagattaaagatatggaacgaacactttacggtacttatcacagaaatattattgaatattccacaagccgtattaaaactccggaaagtattgtggaaaagctccatcgtaaaaatcgggaagtttctcttaataaggcaatagaaacgcttcgtgacctcgccggcatccgcatcatctgttcttttcaggatgatgtctatcgggtagccggagcaattaaaaagcttcccggctatgagcttgtgaaggagaagaattatattacaaagccaaagtccagtggctaccgcagtattcaccttattttaagaccgacaaaaacaacatcgaacatcaaatgcattgaagttcaagttcgttctgctgccatgaactactgggcaattctcgaacaccagctctgctataaaaacgaaaaaaaaggggcggaacgcatccgcaaagaattaaaagaatgtgcgatcgatattgcaaaaattgataaaaaaatgttgaagcttcgaaaagaaatcgagaagatttaatatcagaaagatatcctttcagtacaagcgtttccatttacctttcccacaatctacgatacactatgtgtagattatgggattttattgttattatacataatatagagaatatagagaaaggcatctttttttatgagtcatacagaatttactactacgacaaatgaatttatcggaactgcggcaggtcatacgatcggaatggtgattccgaatattgacccggaagtacgcacacttttaaagattccggagcagtattcttctcttggcattcttacttcaagaaccggtgccgccgcacaggctttttcagtagacgaagctgccaaagcctgtaatgtggaactgcttattttcgagctgccaagagataccgaaggttattccggtcatggtaaccttattgttcttggtgcatatgatgtaagcgatgccagacgtgccgttgaagttgctttaacactcattgatgaaaaggctgaacgtatttatattaatgaagtcggtcatatggaaatgcacgtcacagcgaatgccggtcccgtccttcaccagatttttgacgcaccacttggcaaggcatttggcttcatctgtgccggtcctgccggaattgccattgttgctgcagataccgctgtaaagtcctctccggttgatattgtatggtacggtaccccttccatcaacttatcacgcacaaacgaggtcattatcggtgtcagcggagattacggtgctgtaaagaaggcagtcgataccgcttacgaaaaagcaagtgccctcatcgaagtattcggacaaaagcctgcttctattttacactttaaaccaatagaaaacactggcaaggcagagtaagacaaagaatacatcttattcaaaagatttataaaaaagcgcggaaacctatcatatatccgatacgttcccacgcttttttcatgtgaattatttcaaatcataatcatctaaaaaatgatgcttcactccatcttttttataagcaatcaccgtttcaatattaacattttccacgctcttaaaaatatgtgcttccacataaggattcttctttttaagctcagcgatgagctgcttaatctctattcgctttgactgattctcttcattattacatgttgtacatgtatctgtgaacttacatgcacactggataaagcgaagattattataatccctccatgccttaatatcatcttcacgaataagatataacggccggatcagctccattccttcaaaatttgtactgtgcagcttcggcatcatcgtctgaatctgcgctccgtaaagcattcccatcagaatcgtctcaataacatcatcataatgatgaccaagcgcaatcttattacatcctaattctttcgcaaaattataaagatatcctcttctcattctcgcacaaagataacaaggcgacttctcaatatgatataccgactcaaaaatatccgactcaaaaatatg

SEQ ID NO: 457 - DNA, 16675 bp, Eubacterium hallii
cctttttctttgctaaagcggctgctgctactgctccgccaaatgccacatgtggtccgaatacagaaccaaaacttaatgtacctattacaggcattcctgattctcctgcaaaaatggcaataattactgtaagacctgtaaatacgaatgccggaacacctccaatggcagcaccaagcattccgccgccaaatgctgttataagttgaattatattcattttcttttccccttctctatctttctatctgtcccaaatgttcaaacgatgtttgtaatgcatcatgcatttctttgtaaatatcaaaatgttcctcatacattttcttttgactttcattcggatagtaaacttttttcactttcaaaagttctcttgctttttccaatacatttttatacaaacctgctgcagtaccacccagtaatgcagaacctaacacagcactttcattttcctcaattgtttttacttctgtctgataaatatcggctttaatctgattccaaagttctccttctgccgcaccgccgctatggtaaacacaggaaatatggcatcctgctttttccataatttctaatgttcgtttgtgttcaaaagcaattccttcctgaatagaacgtaccatatgtccttttgtatgtcttggagacaatccgataaacattcctctggaatagacagaacccaaagttctttccccaactaaatatggatagaaaaataatttttcagcaccctccggtgtttcttttgccatctcatttaagtcatcgtaactttcttcttttgccagtgtatctctaaaccagcggtatgcacctccggaagaatccagacaaccaaatgccagccatccttccgccgaatatcgaagattcatcaaacgctcgtccagaatcggttcttttgtataaagacatattgtagaacctgttcctgtaatatctgccaaatcaccataatttaacatacctgcaactaaaagatttgccatggtatctccacatcctgctgcaacagaaataccttcctgcaatcccaattcttttgctgcatcttttgttactgtcccgattttttcataagaatcatatattgttggtaatttctctttgtcaattccaagtaaatctgtcaattcatctgaccatctgcatgtcttccaatccatcaaataagttccggaagcttcagaagcatcaattactgtctctcctgttaaacaataattaatataatcttttacagttaaaaacttccatgttttttcataaatatcaggttggttttctttcacccatttcattttaaagccaatccaatttgtaataggagcattggctgtcagctcataggctcttttatcttcgttataaattttacaaaaatcgtctacaatcttatcatttcgtttgtcacaatataattgtgcttcatgtgtcagcagttccccgtttttatcaatcataaccgctgcatgcatatgcccatcaataccaatagaaacaatttcttctttgtttacttcgctttctgcaagcaatgccggtatctcttttttcaaaatattccaccaggatgcaggatcctgaactgcccaattcggtttaggtgtctcaataaaatgtgaatgtcttctcatagcaatgatattgccatctgtatcaactaatgcaactcggatactctgggttccaatgtcaattcccatcattaattttctcatagccttgcttctttcccccctgtatattgatattatatagttttgtcatgacatagctatattatatcaatgttttttctttttgtcaatcctgttttaatcttaaaaaaagtagacaaatctttgttacttttcacgttacttttcacggggtatgacaagctcttcgtcaaaatgctgaaattgaaaaacttttttgtagataactaattgtggtctcagtagacatgtgaatgtctgttgagactatttcttttttccctacttatccacgattgtcttatttttcttaggaaatctataaaaatatcgagtatttctatgcctaaaagtatggatttaggggacttttccatagtcaaattgcacaatgccattttttcgctaattcgacgtaactttcccattatgttaaaatttcagtataggaaagaggtggtttaggtgggaagaaaacttattccaaaagaagttcgggactttaacgaccttagagatcagctcattgatgcattgcaaaaaaagaatactgtacaggaggagatgattgctgctcaggatgaactaattgctcagcttaccgaagaaatacagacgtttaaagaaactcttcgtgttgtaagagaaaatcaacagttagaaaaggaactggataaataatgtttaactccgtatttgaacgtatcacatatcttgaatatcagctccaggcaaaaaaagcacttattgatgctttcgaatcaggggataagtatgttcaaatgcaggaggaatatcgtaataatctgcgacatttagaaaggcgtattaaaaatcttgaagctaagttagaaagtgcctaccgttctaatataaaaatgcgcaaaaattggatggatgtttttgaagatcttgagaaagaaatgaagaaaactgaaaaaatatttcagcgtcatattaaacagctatgtagaaagttgttaaaggcagaacaagaacgtgatgaggctagagataaaatcaaagaacagcgcctggaaatatatgatttaaagacgaaactcgaggaagaacaaggaaagaaacaacagttactcgcacagatcaaccgcgattatgagaattcttctattccatcttccaagaaagaaaatcgcaaaaagattgccaacagtcgtgaaaaaacagataaaaaggaggcttctggcataatggtggaagcctaacaccataaattaacaacaccatattgaaaaaaccacttgtgtcctttaatgtattaactgcgtggactgggaaactgtagaccgctgtgtcaatcgcgctcttcacgatttagaaccagagcgttcaagaaggctcgatggtctggttaatattggcattgatgaaaccagttataaaaagggtcacaagtacatcacagtaatcgttaatcacgatactaacacggttgtatgggcatcagaagaccatggcaaatccgttcttgaaaagttttataaacagctgactccagagcaactatccagcatcagggttgtcaccggcgatggtgccaaatggatcacagaatgtgtaaatgaatacactcctgctgtgcccgttgtgttgattcctttcacgtagtcgagtgggctatgacagctctcgatgaagtcagaaaagatatctggcatgatgcctacagcgaatataagcaggtcaaaaaagataatccacgtggcaaggggcgtcctaaaaaggatgatcctgaacttgctattgtgaaagcagctaaagttaaagcagatgagataaaaagctctgcatatgcacttggaaaggctcccgaacatctgaccgaaaagcagcagctccgtgttagtttgatctcttcacaaaaccctcggttgtatcgagcctacctacttaaagagcagctccggtaatgcatatagactgtacaaatgcccgtgttaactgggaaagtgcgcacgtattcgttaacgcaaccccagatggaaaagtctattattcagccagtaccaagaaagggcatgcaggtgttgaaggaactccggcagaaaactatcagggaattctggtgcatgatcatgaattaaccttttataattatggctctgaccatcaggaatgtcttgctcatgtccttcgttatctaaaagacagcatgcaaaatgaggcaaatcttacctggagcacaaaaatgcacagatttatacaagaaataatccattacaggaattccatagaacctggaagtgtaattgatgaagccaaactaaaagaaatagaacaaaaatatacggacttactgaaaacggcccgagataaatatgattatgaaccaccaactcaatattatatgaatggatataacctttataaaaggatgggaaaaaatatggcaaatcatcttttgttcttacataatttcaaggttccggcaactaataatgaagcagaacgactattgagaggttataaacgaaaacaggcgcaggccgtgtcattccgcagtttcgaaagtatcgaaaatttatgcaggtgcatgagcatgctaattgggatgcgtaaaaatccagagacgaatatcttccgggaattatcaaatatgtttgcataaataaagcgatagcgtgattgactgtgataataagtttacgctatcgcttattttaatgcaagcatacccgtgaaaagtaacaaatctttcccacttgaaaaaatttgtctactccatatgtattaaatatttgctgatacttcgaatcgacttctgtctccccggtatcttgccagagaaaattcaattacttcaccaaatacattaaaccctgttgtggtaaatgactggattggttttcccattgcaatttctaaattttcagcatcttcatttgttgcttcatctacttcaacaatacgctgtacacgcaccactttggtttgattcgttcttgccaaactcttatataaagaatcttttgtaaaatcacagtctaaaataaatccgcattttttacaacttaaatacgttttttgtaatacaataggttcattatctgcaaaccttctgcgataaagatatactacaggctctccctttcctaagccaagtttggatgctattacttcagaagcttttattttttttaattccagtacttccgtcttagggacagatcctaccctgtccatctgttcattaaatgactctaaagtctgcataaaattatgattaattttgggaaaagagacaaaagttcctttacttttcaccctgtataaccagccttcctgcaccaattctgttattgcctgtcgcactgttgtccggctgatctgataatgttctataaattccttttctgtcggtatgatagcatccttttcgtaattcccattcttaatttccccaataattatttcttttaattgaaaatatagcgggataggcacactcttatctattttaccatttaacatcttactttatctcctcacatttttcatcattttataataacaatagtatattataacttactcaaacttcgcacatagatagcatctatgcacctggtgagtagatacaccccttacgagacgtacccctacatagatccgaacgtgcgattttcccgcattcggctccccacaaagcgaattgttcacttatgtcccatatatactgacatatatcctcggttttgttagtggataaacctttaacatatcattaaacgctttccatgtgtagctgattttctggctacgccgattgagccagtaaaacaggctacaccgtaccttataatagaagctgtctatggctctgaaattgtcagttataccgtaataatgatagtatccaacaagtatctgattcaacttagttattatcagacgaagcgtccaatgcctaatggaactgatcagtctatgaacttccttacatttctttgcaaacttcttcttacttgttttccttttaaccctgaaatttcctgacttactatgggagcagtaatgagtcaatcccagaaacgtaaaggtttctggtttcccttcccctctgcatttcctgttttcttcggcatatctgccgaactcaattagtctgcttttgctcatttccagttctaacccgaaattctccatccttttggacagtcttctgtagaactgttccgcctctgccttatattgaaaacagcatacgaaatccaaacttataagcgtgtttggcatgatcatatacctttgtgagaagctctacttttttggaacggttacgttcatacatggaatcatcaatgattagaacatttacacgttcttctgaatcaagaggcctgatggcttctttaataattcgtccagcaagaatcgttgtaaaacgaatccagttgatctgaatcatcttcatgaaacgatatacggtgtctttggcaaaagcaggtgtgtttcgacctgaaatgaaattcatatacatgcttctgtttgaaaaaatcagcagaaacatgtacaggaagatttccattacaggaacgcccttctttttgtaggcattagcagcttttaatgcagatgaaacatgaaatcttgtaaaaaatcttctaatagaagttgaaatctgcttatcattctggttgtcttgtgttatacttttattcatagcatgagcctccggttttaattgtttttcgacaactcaattataccaaaccagatggtttaatgctattttattgccagttattattgaattttcaaggtgcacaggcacttatttaagtgcgaagtttgagtaacttattatatacaaggattcaagtcatttttctcctctttgcctcatctttctatatatttaaaatttcacttatattttttaatacatattccgtattaggaatagacatttcttccttttgacggaaaaaccaggaataatcattgataattaatgccccgtctatgcccacatgatgtgctgcaataatatctcctgctgtatctcccacataaagaacttcctgcttttcgacctttgcctcctgttgtatacgttctaatcgctcttctttgcttaacatcacatcaccggcagccaaaacccagtcaaaataagaatctaactgaaaataagctagacttgcactaattaaatctctatgagaattggtgattaatgcgattcttactccttgcatttttaactcatccaatgtctctttcacatattcaattaatttcatattctgccagtcacttggtaaaatatttttatataatttttttaatttcaataacgcttcctcatttttgccttttggaagtgtttgttcaaaaatagcatcaagaggaatacccacaagtcgtgctatttcttcttttgaagcacatgctccgcattctcttacaatccttccaatcgtatttacatgaaatcgaaatgtatccactaaagtcccatcataatcaaaagctatcactctatatttcataatttatctttccattccttctatttatcatgacataatgatatgatatcattataaataaatttatgtcaagaaaaagccttatatctcagcaccgaaaggtaaattgattttatagcctgccattttaaggatgttcattcttttcacagtttctctcaatttttcttagttatccacattagttggtggcacttattcctttttggaaaaaaatgtgtataatttttcgatttcctcttggcaggcatcaccttctttgctacaattaattcagtcgtgctggtatatcttctgtttttgttagttgccgtccaaagctggctaataattcagaagatatgtttttttgcagcttttttatttcattcttctcaagatagaagtgctcataaagctgtttcatgaaatctgctatctgttccatcagatagtgatttttctgtacacgttcatgaaaactgcatgcatgctctatctttccctgccaatgcttctgtcggttaaatccctgattttctattttccatctgtttcgtccggcatgtactatcttttttgcattacttttggtaatcccgatgcttgtaatctaggcgaatgttgtttctttcacctttccttttgccatctttctttcacggtaatagatcaggttcacatcaaactcatggaacataattttattctgatactcaatatctgttccaacggtttctttttccggaagtgcacgatattcttctgctattgaggaagcactgccctctttatatcgaatgatgtaatcccagtggtaatctttacatatctgtaacactttctttgtaacatataaaccatctgctgtaatgatgatccgcagtctcggaaatctcttttttatcttggctgcaagccttacaaacgctttactttcgcaatcctgttttactgcttcgtcactttgattgatataattctccgaattttctattgtttccgacgcaatactgcataccagattttctccaaaacagattttggcttccagtacgcttctgtgatacttaagatattcattatcttcccctctgttatagcaccggctcaaataatgctcattcttcttttggtatccttcatccagttctgttgcatctacaatcacctgccatttctttaacactctggcattgtcaaaggttttccggcgaatcatggaatatacaatattttgctgaatatcctctaattctttcggatctaatctttccaggaattcattttctgtcactccgtgaggcatgtaatctttctcatcctccctcataaatctataatctctcggaatctctaagccagtaaatacaaggctttcagattccttttttattaaaatcccccacttttttgccaaaaccacttaacaacttcatcgaaaaatgcggcgctttgcgcctgttgattaataagaaccgttgcttgcagcggcagatatttttctatcggaggcgattttttatgttacctgttaactgtggcagccatgctgactaccaacattttgttgttactaatcttcgtaaatattatcctgttcctgatgcccttgcccgctctacatgggatattatcgagcatttctggaatatcgatttatcttttaccgatacttttatggctgataaatattctaaattcgggcctgcaccaagaactccttcctctatgcagcgttcttatcttctttccattgactttaaagttacctcaataacagaatgggctgcccagcttaaaatcaatcccctttatgccattctcagtggatttgaaccggataatactcccggggttggcactttttatgattttataaaccgcttatggaactctgatgatgatcatatgtcacctcatatccatcctctggcttctcataagtaattccttctctggcaagtgccaggattccctctttatctctgcttgtagctaatctgagaaataaagcggaatccatctgtcgtctgagcgttcttacatcccacttttctttataacattctttttcgtaaaaacttctttctaattcatcatcaatctttatcagctcacaaatatgcgaccatgtcaatttgtcagacagtgtctgacaaattcaatttccatttttatgtattacgttgtctccatttctctttagctttttccaaatcgctctatcactatatttcccttgaactaatattatatttcatatttgcataaaaagaaagtaactgttcagaaccaatgtcacttagttaagctttttacaaattaatggatttgtgtgcatctagcgtgaaaaggatgtggtaaacaaaaaaagattaaaaccatcttcattcaaaaaagattttcattgcgatagaaaagttgacttggtactcatatttgcgattcctgctttttaccggtacatgtaaaataattatggaacagaaattgtacaaaatgagcttgctccacagttcaaatgcaacatactctgtttttttagagtgtaaattagtagctccaatggtatgctttagatcgcgaaaagaagtttcgatgccccagcggagattgtaacagtattttatatcgtccggtgtaaagtcttcttcggaaagtgtagtgatgatattttcaaaaacaccaacggatacttcaacgcggacgattcttagtttcagcagatattcatcggaaatatcagttggattaagatagtcgaaagctatgtttttacaaatatagtggtattgtgattctttttcgggatgtttatgtttctttttagattgtgttctggtcagaataagctctatggttgtatccagtttgtcaggaagagtcccgacgccaagaaaacgctgtacattcaaatccttagcacgaattaaaaaatcaacattattttcgattgcatgggcaaaaacgttgtaactggaaaatcccctgtcagcaatgaaaatgggggacccccataggcataccgatccataagattgcagatagcctgaaactcatttttaagacgcccaggctggacttctaaatcaaggtaccgcttagaacatacctcatataaagagatggtatgaaccatattaaaaccggataccgatttaccatttggttcgtggaaagtatctgcatctttaagatttctggcaatgttaaattcagaaccatcacacgcaataagatagtattttccgcgaaatttttctaaggggaatttaaggttaaattccttgagaaggtgacggaatgcagaaacggaaagtttggaacgttgttgataaaaagcagagccagtaggaactgaggaatcatactcaaaaaatttgagaagttcatgatttaggcttccactttccatggaaatgatcagatgcatcattttcttaaaatcaagtttgcgtttgcggataaaatccttatctggattttttacaaaagaagaaagtgagcgggacatctcatcaataatgtcccaaagtgtagttttgacaatttcaggaaatgtcataggtaaacctccttgaatcagaatgaaatatagttctaattcaagggccgctctcgttaccttaaaaatatatcagcaacgagagcggtcgcacattttgattgatgtgtcaactataatttataaatttttgttagaggtttgcctcatagtgaaccaataagcttaactaagtgacattgattcaaaacagtaatgctaaatgtatcaccgatttccatcttatcaaggtcggtaaagagctttgcactcggcagacctctatgagcagagataacactgtgggtactctctccactgatcggaaaacttgttcctttcaaatgtcctgctgcaatctgtaaaataccttcatccgtaccatggtaaatcggcagctctacccctagctttttaattgtgatatagcccatgatgcccgtacctgtgatatcaagtattttctcataatcctttatctcatccggattataaaatgcagacggatgggcggcaagttcctcattatacttctgtgccgcttcaaaatacttcgtataatcctctggtttcatatttgacaccttttcatcgtatgcagcaactgccttcgactgatgcttctgtataaatacatttatatagaatactatttttctgctaacaggtcaatatttttgcttataaactgctcattgtctaaagccagcgggatagcagcagcttttttcaatcattttttaaaaaagatacgaaatcttttatcgtcaaaaaaggtatgcaaaaaaatcctgtttttcgcataccctttttagaatcctatattattttatattactttctattattcacaaagctttgtaaattcgtcagcaacaaactgaaccttcgttccgataattacctgaacagaagtctttccaggtttaataacccctgcaacgcctgcagatttaattaccttatcatttacagctgtgatatcctttacttcaagtctcaatctggtaacacagttatcgatacttgtaatgttctcttttccaccgcatccttccaggatttttgctgcaatggcagtgtaatcattactttctaattccactttcttctctgcttcaatatcgtcatcctctctaccaggagtcttaagatcaaacttcttgattgcgaaaaggaataccacatagaatacgataaatgctgcgattcccagtggaagaataagccatgtcttctgtgctgccggaagggaggatgagaagatcaaatccatagcaccggcggagaaactgaatcctgcacgaaaaccaagtgcaactgtaatcatcgtaaagataccataaagtaatgcatagattacgtacagtacaggtgcaaggaacataaatccaaactcaaacggttcagtaacaccacagataaatgaacaaagagctgctgaagcaatcaggccgattgccagttttttcttttcaggcttagcacatttaatcattgcaagtgctgcaccaggaataccaaacatcatacatgggaagaatccagacatgtacattccaaggctccatgttacatctgcagatgtctcaccagcccagaagtgctgtaagtcaccaagtccgattgtatcaaaccagaatacattgttcaatgcgtgatgtaatcctgtaggaattaacagacggttcagaaatgcatagatacctgctcccacaacatccatacctacaattgcctttccaagtgatacaagtccaccgaaaagtaacggccatacaaataataatactgcagatacaacaatggaaactactccggcaataattgctacacaacgtttaccactgaagaatgataaccagtccggaagctttgtatccttaaacttgttataacacattgatccgatcacaccggcaagaattccaataaatggattctcaatcttatcaaatgcaagtgtctttgttgcgctttcagcgatagatggcatgattgtcgtaacaaaacctgttgaaagaagtgttgtcatcatcagccatgatgcaagagctgcgattccgccggttccgtcattcttctctgacataccgacaccaacaccaactgcaaaaagaattgccatatgatcaatcagcgctgctcctgcttttaccaaaaacagaccaatcagattcgctgcaccctggatatctccgccctgcatagttgccggacataaccaatatccaatacccataaggataccacagattggcagcaccgctacaggaagcattaatgccttcccaagtttttgaagaaatttcataattccctcctccttctcttttaaattatacttaattggattgttccaatcaggttaatatcacacacagttctgtataaaatctctttataaaatcttaagaactgcttcatcgaataaaacatcgccctccttttgaagactgattttatcataggtatctgtattactaatcagaaccggtgtaatagaattcagaccggccgctttaatcttatccagatccacttccaccaaaagatcaccttttttaaccttatcaccagccgcaacatgcgctgtgaatggttctcccccaagtgtaactgtatccaggccgatgtgaatcaatacctctgtccccatgctgcttgtcataccaactgcatgaagcgtatcaaaaaccaacgtcacttcaccatctgtcggagcatatatctttccttctgccgggattaccgcaaacccatctcccaataccttttctgaaaaaacaggatcaggaacttccgtaatcggaactacagtccctttacaaggagtataaattatattttcatttttattttcttttctttttcccttccctctgaaaaaacctaacatgttatctccctttcatactttaccttccacgttaattttatcttataagtcatccgcacagtgaatcttgtttattataattataaaatcaaagaaaaaaaatagaatatttttagattagatatcaaaaatatacggtcaccatcgggtttattagaaaatttgcacaaaatattataattgcttttctacaagtattataattatgaccaacttattttttcgtaatattatctggctgttatttaagaatctcgataattccttcttatcctttgaatacttgatgtatcccaatacaccccttaaattcgatgaaaacttctccagatccttcaggtgatttcattcgccaagtgaacagaaaataaaaaaagagcagatggcagacgtaatgtcggagtgaagagagtgatacccaagccttcttcccgatttaatttcatgtcctcaataagcagaactcaaaaaaagttattatgtaaaaatgcgcctttgagcctgcactccaaatccttcatgtgatttcattcgctgaatgaacagaaaataaaaaaagagcagatggcagatgtaatgtcggagtgaggagagaatgcgaatgagcattctccccacagcgactacctttacatctgccatctgctctttttttattttcgtctaccttccccgaattaaatcaccaaattctccatttctttcagcaaaaatattttctgcccgctttcgagtggttctgtcagattttcattatattgtttcattttttcgattgttgttccgtaatgttttgcaatattccagagggtatcgccttcttttacgatatagccggtaatggatgggattttggagatttcttcttctgtgtacggaatttcctctacctcatcgatcatgtacattgtctgtggtgagaatccggtgacataaattccggcaactgcgcggatttctaattcgttgctgtctacgacgtaaccgccgatctgttctaatactccccggatttcgcagcggtcggattccattacttcagggatttctactaaatattcaaatggtatcacaacttcttttgactgtattggggcggtatcgtctcctgctatgtaaagcacgttgcagaatatgagtccttcggtggcaatgccctgtttcgtgaaatgaaagtcttcgattcgtacatttccttctacattaaggacttgtaatagtttatgaatttctcctgttgctgcttctacccgctggcttacttttgtttttgcattgttctggaaaatgaggttttcaaactgaattgggctagtttttaattttaacttccgattatttgcatacatatctttgagaagcggcattttaaattcgtgatatgctttcaaatcaagatctaaaacgacttccatttctatatcgcgtggttctccgtcaatatccggcttgatcgtcacctgatggtttccaagaagaacggcaatatttcctataagattttcctggctgtctgcacattctaattcgttagtaaatgggatttcccagtcataatactgtactggttcttttccttcttctgcctgatacagaacaaagagaaaaacacttccccgaatcgcgagtttgttttctaacattcggatatccacatctcgaagctgagtcgaattccacagaatttcccggatatttggcttgcctgccgggaggctgaccgttgctttgatccgctgaatgtcttttttattcatgataatttctgtcatggaaggagattcatacaggcactggacattttcctttttttcgattcccgttgtacattcgacaaatttcatttcggagatggcaatgtgaaaatatataacggaacggacaccgcattttctggaattgataatggagattgtcaggtcttcaagatctgctgttactttggcgatatcgctgctctctgcgccttctacattcataaattcttcaatggcaaagtcatgttccatgcaggaaatctgctgctccggatctgtgcttagatacagtatctgcacgaggaagtttccccgcaggcgcagacgatctgttaacacctcaatttcatcaatatgtacttctcccctgctctcgataattttctccacatctggccgggtatccggcacgttcatatcttcgtccagtgtaatctgcacatttttttctaattttaaaataccggaacgaactgcttttttctctaccttcataatacatcctccaccctgcataacgatttttgtgcgcggacatactttgccctgcttgttgtctttgctattaatatatgttttcttcggctgatttatgattccgtctctgccaattcatttttcaggattctatacggcataactgttctgtccgttcacaccggacaactaaaaaaggacaggttcgtgtttctatgatttcttctcccgccgatggtccgatcagctgtgtcttaagatagagctgttctttatctttccaacattcttcaatgcgaatgctgtaaccactgtatggcttttcaccataacagactatcagataggtatattttgaatttttatatgcaaatgttcccggacgatttttccggtcttctattattttctgcaggcggtgcggcatgtttttttccgcacagatctcgtagcttacttcctgcccctggtttttattccccagcttactgatgtgaaagttgttttgaggaaagatgggcgtacaggcggtcatatagatgcctgatatcattatccatatgaaaaaaagtacgatacgatatgtctgatttcttgcattgtaaaccatatcaatacttccaaacatcaatgttattttatttatatgcgcctgctgatagaaatttacttccttattttcgtccgcccaattatatgttataatcataacaatagcgaggataaaacttttttgagaggagggggattgccccatgcatatttctattccaaaacatgcctct

SEQ ID NO: 458 - DNA, 15829 bp, Eubacterium hallii
ttagacatccagtccagagaaattttagaagaagcgattaacaactatgagggaactgtattttacgtttcccatgaccgttacttcattaatcaaacagctacaagaatcctggatttatccccagaaggcatcgtaaactataaaggcaactacaactattacttagaacaaaaagaagctggaaatgtgtctgctgacagcgataacatcacacttgctacctccgctgataaatctcctgccccttctccagaaaaagccaaggaggactggaaacgttcgcgtgaagaggccgcaaagcagcgcaagcgtgccaacgatttaaagaagacagaaaaagaaatcagtcgcttagaagcagaaaacgatcagttaaaaaatgaaatggcattacccgaaaacgctaccaatgtatcaaaacttatggaactcaatactaaatttgaagaaaatgaatctaccttattagaactctatgacaaatgggaagaattatcagaataatttttaatttgtagattcggtatagacaaaaaaataaaaaacgatatatcccctttgctctgtaatcgcatctggaatatatcgttttttatttttctgtctactttaaatccttcgtattaagttctgttttaactgatttatggaattaggttaacatttaattttttactgctttctttaatcactttttctaattcgccatctgtaattgcagttactcgacctgtttcatattcctgatcaacccacttctttacctcggctaccagtggactcttcttgtctactgccttatctccctttaagcgatagtacgtatttatccaatgggcaattccagcaagtccgcttgtatttgataccgctacaagcaccggacggtttaacaatttatctgtatcaaatatgttatagatttcttcatttttaagaagaccatctgcatggattccggctcttgtcacattaaagttctttcctacaaacggtgttctttccggaatgtgatatccaatctctttctcataatactctgccagttctgtaataactgtagtatccattccgtctaatgttcctcgaagctgggcatattcaaataccattgcctcaagcggggtgtttcctgtacgttcaccgattccaaataatgcactgtttacagcagatgctccataaagccatgctgttgtagaattattcactgctttatagaaatcattatgcccatgccattctagtaattctgatggtactccggcatgttcttttaatccataaataattcccggcacagaacgtggaatcacagctcctgggaagtttactccatatcccatcgtatcgcaggcacgaatttttacaggaataccatactcatcttttaatttcataagctccagacaaaatggaataacaaatccataaatatcagaacgggtaatatcttccaggtggcatcttggactgattccggtttcaagacattctcttacaacgcctaaataatgttccatcgcctgttttcttgtcattttcattttatagaaaatatggtaatcagaacagcttacaagaattccggtttcttttaaaccaatttcttttactaattcaaagtctttcttacttgcacgaatccagcttgtaatttcaggaaatttataacccttttccatacatttatataccgcatctctatcttttttactatataagaaaaattcgcactgacgaataattcctttcggtcctcctaagcggtggaatgcatcatatatatgcacgatctgatctgttgaatacggcgttcttgactgctgtccatcgcggaaagttgtatccgtaatccagatatcttccggcatttcatgaggtacgattcggtcattaaaggctattttcggcacttcctcatacgggaacagattacggaatacattaggcttatccgtatcaaccagcgggtacatatattcatctaatttcaataaatttgattttttgttcagccgaactgagcggttatccatttccatagttctatctccatttcttttactaatatgacggcaattcacagtctataaaaacctgtatagtatagttttcaaaagtatcctgactttcaagtcgagcagcctgaattgcataaattatttttaaaaacttcattttattcccgttattattctatcattaaagttaaatttgtcaagagatagtattttttatatcttttttcgcataatataatttgtgttccttcatttactttatcattgcacagcgccacatctaagagttcctgtctacgtttcaaataaaagaaaaacaaaaaacaaaaaaacgatatatcccacctgttctgtaaatgctacgtaaaaaatgttcttgcatcttgaacgcacctcaaaacttcagatgagatatatcgtttttattctttccaatttaaaatcagaaattattatttattaacgtttactttctgcccaatcttactttccgttccagataaaagtctgccaatatttgctctatggcgataaattgcaaaaaatgcataaaggacacacatcgcaaataaatcccatcttcccggatgaaagataagaatttctactacaatacctgctgataataggatcgaagctagggaaacatattttgttacagctgtgactgtcacaaagataataaaacagcataaaccgattctccagtcaaaagccatcattgcggcggctgttgtcgcaattccttttcctcctttaaactttaagaaaacaggataatcatgtcccattactgccgcaaaccctgtaacaagctgaatcagttctgcattcaaatctggtacagccggacataatacaaactttacaataagtaccggaacaaagctttttaatgcatctccaaggaaagtaagtaatgcacgagttttaccaagtacacgaagtacattcgttgtaccagaattcccacttccatagtcacgaatatccattccgcataactttcctacaaggtaaccactttcaatgcagccacaaaaatagcctaccacaattacaagcacataatatacagcagtcatttacttctcctttctctcacgatagatgaaatggatcggagttccacgaaaaccaaatgtcgtacggatctgattctcaatatatctggtatatgaaaaatgtgtcagtttcttctcattaatgaacataacaaatgtcggtggctttacagaaacctgagtaatatagtaaattcgtaaacgcttacctttatctgatggtggctgcttcatagccattgcttcggtaagaatttcatttaagacacctgtctgtacacgaagggcacagttttcaattacggcatcaatcatatcaaaaagctttggaagtctctgtcctgtctttgcagaaaggaaaatcagttccgcatatggcatataggaaagcttttcacgaatcttttctgtgaacttcttcatcgtggtattatctttttccacaagatcccacttgttcactgcaataatcatacctttaccacgttcgtgggcaattcctgcaatctttgcatcctgctccgtaattccttccgttgcatcaataatcaaaacggcaacatcacaacgctctacggctgtaacggtacgaataatactgtaacgctctaattcttctttaatcttactctttctacgaagccccgctgtatcaataaagatatattcctgaccattacgctttaccgttgtatcaatcgcatctcttgtcgttcctgcaaccggagatacaatcactcgttcttctccaagaagcttattgataatcgaagacttacctgcattcggtttaccgattaccgcaatcttcggacgttcatcttcctcttcctcttctcgtgccggtgtttcaaactgttcaattacatgatctaacatatcacctattccaagtttgccctgtgcagaaacaggaatcggatcaccaagaccaagattataaaattcatagacatccggcatatatttttcaaagttatctactttgtttacgacaagaagaaccggacgatgcgaacggcgtaacatatctgccactttaaaatctgcatctacaagtccctgacgtacatctacaaggaacaaaataacatctgctgtcataattgctgtctctgcctgttccctcattcgtgaaatgataatgtcatcagactcaggttcaattcctccggtatcaatcagggtaaactgatagtctaaccagctgacctccgcatagatacggtcccttgttactcctggtgtgtcttctactattgaaatcctgcttcctgctaacgcattaaacagcgtagatttccctacattcgggcggcctaccaccgcaacaaccggtttactcataatttcctccattctctatcgtaataattttatcaacaaagtctcttccctctgattgtataatatttacgggaacttgtaaagaatcggaaagttcctttaatgaaatgtcatcaaggaaaatatcctcatctgcttttaacacattgcatggaaggagtagttcctctccaagcatctttccttttaactgtgcaataatatcctgtccggtcaaaagacccgaaactgtaatatgttcaccaaaaaatttattaataatacagtacacatctatcttaataccagggaatttcatttccacatccgctgcaagctttttaatcgttggataggcaagtttcgctgtcgcgattgctacatgtttttcccgatcatcaccggtaagctccgcaaggcgttcttttacttcctctagcaaaagccgcatcataccgacaccattttcaagctgtccatagccttcataatacgcctcatctgggaattcctgttctgcgagaataaaccattcatcgcttgcatgaacaaaggttgttccataattttcacgaaaataatcctgccatttatgaatctgcttcagcactttatgtgcatcttctttttcaaaaagctcaagcggagcaagaccttctctgtactttgtaagaccaaccggaacgacagataaactttccatgtacggaagaaactttccaagatcagatatcgtccgatcaagttcttctccgtcattcaatcctttacacagtacgacctgactgttcatacgaatgcctgcttcataaaatcgtcctattttttctaaaatatctcctgcaaaacgattgtgaagcatcttacagcgaagctccggattcgttgcatgaacagagatattaattggtgataaatgataccgaatcactctttcgatgtctttatcacgcatattggttaatgtaatataattcccctgtaaaaaagacaaacgtgaatcatcatctttaaagtaaagtgtttctctcattcccggaggcatctggtcaataaagcagaacatacatttattacagcaggagtggtattcatccatgagagaagactcaaaagtaattcccaaatcttcatcctcatctttctcaatctccaatacacactcttccccgtcttttgtgagaaccagcacatctaaatactcttcttccacataatactgataatcaaatatgtcttctatttcatttccattgatttcctctatggcatctcccggctctaaaccaagttcttcagcaatacttcccgattcaaccgaggcaataatatgcaaatgttttttcattcttcttctccatttattcaaagattcctgacataaatcatataattcaagaatgcctcggcattcttgctacgaaattttaaaaagttacagacacataaaacagcccatatttcctcttttcccatgacttgctctatgtgaaaataacttgtcgctattacaacaggtacaaatgtctgtgatatccagattctccttacggattcccgcctgcgtaagtatgagttcatttaccttccataaatccaactgatactttccattacctttatcatccatgatcaacggtatttcctccggcaaaaacactttcttaaatgcatctgcaacttcttcaccaacttcatagcagtttcggcaaatagacggaccaattgccgcaataatattttccggcttacttccgtattcattttgcatatatgctacaaactttgctccaatcttttttacagtaccacgccagccagaatgagccattccagccacatggtgttccggatcataaaaaagaagaggaacacaatcggcataagaagtatagaggggaatccctttctcatctgtaataagtgcatcaattcccggcactgtttctcttacaatgccatcgcccttatcctttgctgcaactttacgaatcctggtctcatgaatctgagaagacaacaccagatctgctgcattaaaaccaattgcttctccgattctttgaaaattctcctgtactttttgtggatcgtctccacgagtaaacgacagattcattgaagaaagatatccttcacttacaccgccgattcgagtagaaaacccatgacatactccagccttcacaagctttggaaatgtaaggaatactacaccatttttctcatttatcattgtcgaatgattctcattagcatatacaaacttcatagctttctccactgtttctaattcaatccaacacttattcctgaaactcaaatgcattctttatccagtgacattgtaaatctttatctacttctataacatcaaatcgaacagcagttgtgtccataagctgttttttcatacgataataatttaatgtataacagattcttttttgtttttttaaattaactgcttctgctggagtaccacattctttatttcttctcatctttacttccacaataagaatggtttctttttccagcgcaataatatcaatttctccatggtaacttcgaaagtttctctccagtatgcgaatccccttttcctcaagaaaaagagctgctgcttcctctgcagccattccgtaatttcttcgcactgctgtcttctccattcctttaaatctgctctccacaaatgtttttaagaaaactgcgacgatgtattggacatggaccctgtcgatgtatcgcctcgatatgttccttagaaccatatcccttattggatgcaaaatcatatcctgggaaaatatgatcatattcttccatcatacgatctctgtaaacttttgccataatacttgctgctccaatagaaatacttttggcatctcccttgataatcggaacctgtttcatgtccattcccggaatcgttactgcatcatttaataacagacttggcttcacagacagatttgcaaccgcctggcgcatcgcttcatacgttgcctgtaaaatattgatttcatcaatacgctctggagaagccattccgattcctacagaaaccgcttctttttgaattacctcaaataattcttctctcttttttgccgaaagcttctttgaatcattaatgtataagattctgctttcttttggcaaaacaaccgctccggctacaaccggacctgctaatggtccccggcccacctcatcaattccacaaataaactcatattgactgtattctttctcaaaccggcacagattctctattctctctacttcctgataatacttttccaccttttttttctgagaaagcaaaaaactctgtacgccttttctttcatcgttctgatacaatacaatctgtgcagaaatttcttctggggtaagatttttaaattcttcttttatagcagtaatacttttcattttttaagaaacctttccaaacttatttaacggccagattcttatccataccttaccaataatttgtgaacggtgtaccggaccgacctcctcatagcggctgtcataactgacaggacggttatctcccaaacaaaaatactcatccttaccaagtttttgcgcactctttgccacacctgcctcatcgatataatccgtaatgccgtatatatcgctttttagcttctttccattgatataaaccttgcccttttttatttgcaccgtttctcccggcagccctataatacgctttatataatacggatgttctccatattcttccggtcccggaaaaataacaatatcatatctttccggttcatgaaaacggtaggataatttatccatgataaggttctgtccatcagagagagtagtatccatagaatctcctcgtacaactgtcctctgtcctacataatgaagtataaaatatactatcgtacataaaataacaagatacagtattgtaccgatcacttctttcacgttctttcttctctgttcttttcttctgcgctgccgccttcccagtgttacttcctggttcttccttgctcttctagccatatttcgcagacaccttccattcaagatactttttaagacactttactttatcagatcaggaaacttttccaaacttatttaatggccagattcttatccataccttgccaacaatctgtgaacgctttacggggccaacaatctcataacggctatcctgactgaccggacgattatcccctaaacagaaatactcatccttccctaatgtcactggctcctcggctattcccggataatcaatataatctgtaatgccatatacatcactctttagctctttatcgttaatatagacctttccatctttaatctggacggtttcacctggcattccgataatccgcttaatataatacggatgcattccttcttcttcgggtccagggaaaatgataatatcatatctctttggatcatgaaaacgataggaaagcttatccataaccagattctgtccatttgccaatgtggtatccatagaatttccattaaccactgttctctgtcctacaaaatgtaaaataagaaatacaaaaatacagacgccggctatgtatgcgatcgtacctaaaatattttttgcagtactgttttcctttgtcccactcgtttctttctcactgttcttctctgtttcaatttctttattgctcatctggcacctccaaagacaacttgccaagacgcaaggaacggaaatcctctaaaagaagtcgtcctgctttgtcaatatccatctgatttcctttcatcagacatcctctcactcttgcaatttcttcaagaatctctaaattctctttgccctcatctacagcatatctttcttccagtacccctttataggttttcttcaggaaatcaataaacgcaattgccatctctgttgtattaagaatctcttctttaatagaaccgattaatgccagtcgaagtccaactgcctgatcttcaaatttcggccataaaatacctggcgtatctaaaagctcgacattcttattaatcttaatccactgtttgccctttgtaacacctggtttatttcctgtcttcgcacaggctttgcctgcaaaagaattgataaaagtagactttcctacattcggaattcctacaaccatcgcacgtagtggacggtttaatattcctctctttttatctcttgcctttttttcctgacagaccttttctatcagagactttacttctttcattccggcacctttttgtgagttcacctttgccacaaaaaaaccttttgcttcaaaataactctgccacgctgccgttgtttttgcatctgccatatctgccttatttagcacaataagacgatacttattccttgccagttcatctatgtccggatttttactgctaagcggaactctggcatctaccagttccactacaatatcaattaacttgatattctcctgcatcattcttctggcctttgtcatatgaccaggataccactgaaaatgcatctctttccctcctgctattcttcctactgtctctttgctttatgaatcgtacctgttattttaccgacaaattgtgaacgtttgatgtttccaatattagatactcttgaatcttcactgttattacagttatctcccatcacaaaatactcatcatcttccagtgccacatcatatgcagctaaacctgctgaaaggatttcttcctctgaaaaacctttcagttctttattatttatataaatctttccattctctatttttacagtttcacccggcagaccaataacccgctttacggaataatgtattgtagagccattctcaagctctaaaataaccgcatcaagcctctttggactgccgaatcgataatccagtttatttaccaacacagtatctccatcataatatgcaggctgcatagaatccccatggacagttactgtctgaaaacaaaactgaataaccaaaaatgctaacagaattgctgctgcaatctctccgacccatagaccaattcggcggatcatcaaatttcttctttctaaatatcgataatttttcatctgttttcacctgtttcccggaaatctgtatggaaaaacagggcaagtataaatactcgccccgatttttgtgatactatttaactaattcttttaccttagctttcttaccgattctctcacgtaagtagtaaagtttagctcttcttactttaccttttcttactacctgaatctttgtaacgattggagaatgtaatggccatgtcttctcaacaccaacaccattggagaactttcttactgtgaaagtttcttttgctccaccgttctgtctcttaataacagttccttcaaatacctggatacgctcacgtgaaccttctactacctttgcagaaacacgaactgtatctccaacgcggaaactatcaacttctggttttaactgtgcatcttcaatacttttaataatatctttcatgtgtgacctcctatatattctcggtgttcttaatacctaaatgtaaaagcggaccaccttttttcacaacttgttaagtgtaccatactatgcctggtcatgcaagtctttttttaacttttttaaatacttttcatcatctttagataagtcagcctgctctaacaaatctggccgtctttctaaagttctcttcaacgactgttcccgccgccatttatccacattaccatgatgaccggacaaaagcacatccggaacccttttcccatggaattctaccggtcttgtatactggggatgctctaaaagattgtcatggaacgactcaaattcagcagattcttcattattcaaaactccgggtacaagacgggaaaccgcatcaatcatgaccattgccggcagttctccgcccgtaaggacataatcaccaatcgatacataatctgttacgatttcttctaaaattctttcatctaccccttcgtaatgtccacataaaaaaatcagatcttcttctttagcaaactcttctgccattgattgattaaaaacagctccctgtggtgtcacataaactactcttggttttttctctatattctgtgtaatatcctcatacgcaagataaatcggttccggctgcatcaccattcccgctcctccaccataaggataatcatccacatgtttatgtttatctttggaataatctcgtatatttaccgcattcagatgaatatatccattctgtaacgctcttccggttacactcgtatgaagccctgcctcaatcatatccggaaacagagtgagtacatggaaattcattagtccaccagccctttcagcatatgaaccaaaataattttctcatccatatccacatcaagaatacaatctttgattgccggaagaagtacatgacctccatcggatgtttttacttcgtacacgtcattcgcaccagtctctataacatcaacaagctcaccgatcgttacaccactttcgtcaacaatcgtaaggcccagcaaatctgcaacatagtattcatcctcttctaatggaacagcattctctctcgtaactttaagaggacatctcttatacttttctacgtcattaatatcatccagtccttcaaactttacaaaaacaaactgtttgaaaaacttacaatactgcaccttcttctcaaccagttccttacctgtgtcaataaggaccgtatctaagtcgaggaatctttctttatcatctgttgttggaaaaactttgacttcacctttcagtccatgtgttcccgtaataataccaatctgaaataaatcttccataccttattatctccattctgccgttgaattcttccctgtatagaaaaaaatgttacctgctcaaatatttacaggtaacatttcaaatgcctattactgtgcgatatcaactatcacttttttatcatcgcgggatgccgctgcctttacaacagtacggattgcctttgcaatacgtccctgtttgccaattactttgcccatatcatctggagcaacatgtaattctaagataatggagttctctgtctccttctctgtgacaacaacttcgtccggatgatcaacgagagaaactgctataactcttactaattctttcattatattagcctccagttattatttctcgataccggcattctttaataatcttgcaactgtgtctgttggctgagctcctttagaaagccagtctttagctgcttcttcatcgatattaactacgcatggttcctggttaggatcgtataaaccgatttcgtcgatgtttcttccatctcttggagatcttgcatctgcaactacaattctatagataggatttctctttttacccattctttttaatctcatttttactgccatgtgattcacctctttcataatatttgtgtataattcattcatctatattggaaccggttgcccggataccatcgttaattaaactttttaaatttatatttaaaatggaagcttcattccaccaaggttaaatccgccttttctgcggccaccctttcccatcattccattcatctgcttcatcatcttacgtgactgctcaaactgtttacaaagcttattcacatcctgaagctttacaccagctcctgctgcaattctcttcttcctggaagggttcaaaatacttgggtttgctctctcttccggtgtcatagaataaatgattgcttcaatgctgtccatcgctccatcatctatatctacattcttaagctggcttcctacacctggaatcatcgaaaggatatctgtaagaccacccatcttcttaatctgctgcatctgagaaagaaaatcatcaaagccaaactctgcttttcgaagcttctgctctaactttcttgcttcttcttcatccactgcattctccgctttctcaataagagtaaatacatctcccattccaagaatacggcttgtcattcggtcgggataaaactgctgtaaatcttcgagtttttcacccatacctacatataatatcggcttacctgttactgcacgaatagaaagtgccgcaccacctctggtatcaccgtcaagcttagttaagattacgccgtcgatgccaaccttctcttcaaaagtcttcgctacattcactgcatcctgacctgtcatagcatctacaaccaatacagtctgtgtcacatcaacgttcgcttttatattctgcagctcctccatcatagactcatctacatgaagacgacccgcagtatccaaaataacaatattattgtcattctctctggcatgctcaatagaagccttggcaatatctacaggattctgcttatctcccatagtaaacacaggtactccctgctttgcaccattcacttccaactgcttaatcgctgccggacgatatacgtcacaggcaactaataaaggctttttcccctttttcttaagctgtccggcaatctttgcacaggttgttgtcttacctgcaccctgaagacctgccataagaaaaacggttatctcattccccggcctaattaccagttctgtcatctcggaacccattaaagattccatctcttcttttacaatctttattaccatctgacctggattaagtccagtcagaacatcctgtcctatcgctctgtcagttactgtcttgacaaaggattttactacacggaagttaacatccgcttccaacagggctctctttacttccttcatcgcttcctttacgtcagcttctgtcagacggcccttgcttcttaaattcttaaaaacattctgtaatttatccgtaaggctctcaaatgccataacaaaatctccctgctcttaatactcttccagtatcttactggacagttctgcaatctgtgcaatcttctctctgacaacggacttatcatcacactccgcaatctcttctgcacatgtatgaatggaagctactgtcttctttactttttgaaaatgctctaccagatgaagacgattctcgtaatctgtaagaatcttctcgcatctcttaatcaaatcatgcgcaccctgccggctgattcctcgaattgatgcaatctctgtaggagataaatcattctgaatgtattcaccataaacatctttctggtgctgtgtcagcaattcaccataaaaatcaaaaagtaatgacttctctactattctatccaatagtctctcacctcatgtcatgtaaagtagttttactttacagttggctattatatacgatacaaatatttttgtcaagtactttcccttgcttttttaatactaatttatgaggctaaggaaacgaaaaccagaaatttaataaaacagaaaatgtgaagatagtcgcagcgtagaaaatgcctgctcggcatttttactcgctccgacatcacattttctgttttattaaatttctggttttctgttcattggcagcggaagaaattagtatttaaatttttttgggtaacaatgggattgcccagaagtctatgctgttcattaaagtcaactacccacgacctaaaggtcatgggcttgtaactgcccagtcgtactaacggcttacacctccgacctttaatccccgatagatattgctatctaaagtggcgttacatcatagggtggttgacagcaccctttgtagcagagtttactctgttacaactgtattaggtacttggctatctgcaagatagtctattcccatacgatacagattcatagctccaatgcggtcatcattagatttgtaaccacagtttttacaagtaaacaggtgtatcttcttactgcggttagacttttcaacgtgcccacaacaagggcagcactgacttgtatagcgagggtctaccttaataacagaagactgattctgttttgctttgtagattaatttttgctcaaggtcatagaaagaccatgatacagaaacataacggtcttttgttttaacacgttctgtagcattacgaatacctgacagatcttctaatacaaagagagtgtgctttgggttatttttaacgagtgcctttgacacctgatggttaatatcccgcatccaacggttttctcgcccgccaatagcttttatccttcgtcttgaagatgctgtccgtcgcacttggagttctttacgaagtttggaataattagcacgtttttgctttatagccttaccgctaacaaatccagacttgtgtttgctgtcataagtggcaacaacaaagttaatacctctatctatgcccacaacattacagatgtca

SEQ ID NO: 459 - DNA, 15027 bp, Eubacterium hallii
  modified_base (9356)..(9455): a, c, t, g, unknown or other
  misc_feature (9356)..(9455): n is a, c, g, or t
ttgttatgtggccagttcgtaccgctgtttccggaaagcgtatgactccaggtggagcaaccgaaattatggaaatcatcggaaaagaagaaacagtaagcagagtgaaagcagcaattgagaaattatctaaataataattgcggggacacagacgctactttagtagaagatattgagctgaattgtatggagtcttctaaagaaaaaagaatggttataagttagattttgttccgttgcactaaacattccattctgcccagaaaaacaggaacttgggaaaaacgagtcccaagttcctatggtcagaattccatagtgcaaagtcacaaaatgcaatacttataaccattcttttttctttaccatagttttcttacaattcagcaggaaattttgtttcagcggctgtctgttcttaataaggaattagtattttagtctgagggaaaagaggggattgtccagaagtctatggttttcactagaataaaaatctccaaaggagaatattttcccactggatttgtagtcaatcttctaaagcaaaaggaattgtaaggacattattatagggaaagaaatcggattaatcggaaggctttgacctccactgctattttcttatgcggaacagttctttgattaaaaatcatagttttctggacaatccctttatttccatccaagatttaaatactaatttccatctgaaaccaaagaacagaaaagcaaaaatttgatatagaagaaaatgtgatgtcggagctagtaaaaatgccggtcaggcattttctacgaagcgactatcttcacattttcttctatatcaaatttctgcttttcgtttctttagttcctcaaattagtatttaatcccccattctcaccaactgtggatttggaatagtcagaaaaaagaaatactaccatatcccagatgcggcttcggagcgtgtttaagatgcgaacgagcattttaaacacagcgactatagagcagatgggatatggtagtatttcttttttcgtctatacgaaatctacaaattagtgttttttacctgttatgatgaaagatttgtaatttttgacaaggttattgatgttatttgtagtaagattgaaggtgtcagatggccaaatctcttttaaaggatattttttgaccattttcttgtattctgaattaaatttcttctttgatactttttttccattaattttataaagagtttttggaagataggcttcttcaaatcttttaagcttcgttccttttccctttttgttaaagcgataaaatgttgaaatggcgccatatccattaatccatgcagaattagatactacagatttctttttggagtaaatgaggcgaccataatcactgccggcatattttaactgtttaagtttgccgccagtgtaggtataaacttctccagcaacggcatgtacgctaaaatccggtgtaatgagaagttccggtatagaatctttgtcgagataaattaaggcaaatttattgtatcgggagtcaaggcgggtaagttttttctgataggcagttagtgcctttgttcgtttcgatgcggcatttacattagctgcgggtgcaaataatgtaaagagcatatatagggttaatatggcaacaagaatgcgttgtttggatgttttgattttttgcatagtgtgattcctttcttgagtttgactttacaataggtggcatcaagttagggacaaaatgtttttgaccctaacatcattatatattataagaagaaaatagaacagaatatattacaagatttacattaaaaattatgatttttaacattgacttttctcaataagtatgtaaagatataaacataaaataaatctgccaacgcagaaattctggttactgacggatatgtgaagagacacagtgtagccggagggatggagacatcttgttattagccgaccgtctgggcagcttcttttgaagttgccctttttgtttttaacccaacaatttatctcagtcgagaagactcccacctcctttaggcggctcgacttgaattaaagacatagtaaatagggcaagggtataaagcagaagagaaagtgtgtaaagtatttatatgcgttaaatgaaaggaagaaggatatgaaaacagatattcagattgcacaggaagcaacaatgcttccaattaaagatgtagcagcaaattatgggattacagaagatgatttagaattatacggaaagtataaggctaagttttctgatgagtttatgaacagtcttgatgagaaaccagatggtaaacttgtattaatgacagcgattaacccaactcctgccggagagggaaagacaacaacaagtattggtcttgcacaggcattagagaagttaggaaagaagtctgttcttgcacttcgtgagccttctcttggaccatgtttcggaataaaaggtggagctgccggaggcggatattctcaggtagttcctatggaagatttaaatcttcattttacaggtgatttccatgcaatcacatctgcaaataacttattagcagcacttctggataatcatattcagcagggaaatgaacttcgcatcgatacaagacaggtaatctggaaacgttgtatggatatgaatgaccgttctcttcgtaatattgtcattggtcttggaagaaaagtagacggttatgtaagagaagatcatttcgtcattacagtagcaacagaaattatggcgattctctgtctcgcagaagacattaaagacttaaaagaacgtttatcaaagattattgtagcatatgacgtagatggtaatcctgtaacggcaggacagcttaatgcagttggttctatggcagcattattaaaagatgcgattaagccaaatatggtacagacattagagcatacaggcgcaatcgttcatggaggaccatttgctaatattgcacatggatgtaacagtgtacgagctacaaaaatggcgttaaagctttctgatatcgctattacagaggctggattcggtgcagatcttggtgcagagaagttcatggatattaagtgccgtatggcaggcttaaagccagatgcagttgtattagtagcaacagttcgtgctttaaaatataatggtggtgttccaaaaacagatcttgcagaagaaaatatggatgcgttgaaaaaaggtatctgtaatcttgaaaaacatatcgaaaatcttcagaaatttggtgtacctatcgttgtaaccttaaatgcgtttgttacagatacagaagcagaacacgactttatccgtcagttctgtgaagaaagaggatgtgaattcgctctgtctgaagtatgggcaaaaggcggcgaaggtggaattgaactcgctaagaaagtattgaaaacattagaagaaaaagaaagtaatttcaaagtactttatccagataatgcacctttaaaagaaaaagtagaaaccatcgcaaaagagatttacggtgcagatggagtgacatatgagccagcagcagaaaaaatgcttgcgaaacttacagatttaggattcggtgatctgccagtatgtatggcaaaaacacagtattctctttctgatgatcagacaaaattaggtcgtccggaaggtttcaacattcatgtacgtgatgctttcgtaaatgccggagcaggttttgttgtaatccttaccggagcaatcatgacaatgccgggattaccaaagaaaccagcagcatttggcattgatgtagatgataatggaaagatcacaggattattctaaatcctgatttgtagatttaatgtagacgaaaaaagaaaaaatgatatatcccagctgctctgtagtcgctgtatttaagatgctcgtccgcatcttaaacacgctccgaagccgcatctgggatatatcattttttcttttttctggctatctaaatctacagttggacaatgtggaatgtaccagaaggacatgactttccgggaaattaaagtctaaaggattgacgcatttcttctggagtttttcatttgaatagaaattgtatacttctggacaatctcttttccttagaaacctcaatgcaattcagcagaaagatactcacttctggggagcccccttattttttctacacaaaatcctgatttcatctggcgccaaagaacagaaaagcagaaatttaatatagaataaaatgtgatgtcggagcaagtaaaaatgccaatcaggcattttttacgccgcgactatcttcacattttattctatattaaatttctgcttttcgtttctttagttcatcaaatcaggattattctacatttaaccacattgctggttttacagtgatattagtattggttacttcatatccataatccataacggttttatctttgtatacaaagctcatagagttttcggctgctcctggagtacgaagccaccaacagctttttgtttcatgaatggcatcataatattttgcaacttcatcgcagctaagtaagaagaatttatctttggtattattacctgctagagttttataggttgcatttggtgtgttttttacagttgtttctaaaatactgttccgttcattttcagtgaaactttcctgaagaaaatctttgttaagccattcacgtacggaagaagattcccaagttacattctgccctttttcatcaaatggtgttgaaccgaaagcattatctttgagcaaaagtacttttccgtcttttttatcgagtactctccagtccatatgggcaaaaggaattacttcccctattttagtatttttaacacgtgctttttctaatgcaacaaatttagattcgctgtctttatagtcttctttagaaagtgcattataatttttataggcggtattctcgtctccatttttataagcttgttttgcagatttgtaacgatattctaatgctttttcatgggcggaaatatctttgtccttcatataaacaatttcgtaattctgccatgttttttcatagtttcctgtatgtgagtaaatgccggcgagacattgcctaaaggaaactgtccgagtgaaaaacagtactgcaagtatacaaacaatgaaggtacagcttacaaaaagactgtgatgttttaactgggaggccttctcatctgcaagcttttcacagagtttcatctgttcttcagaatcattacacttgatggcttctgcatatacagaaggctctgtccatttttcaacgaggggatgtgtctgctcatagtggtaaatacgagaaaagattgtttgagcagagtagtagtcattcggtgtttttgctttatcacgaatatgacatgcttctttatataattctattttcccttctgcgcgtgtgttgaacttctttttcttgagttctctaagaagtggccgcacatctttataaggtttgactttttttaaatattggatagcacgatgataatatttgccctggtcttcaaatttattcatatgttccgctatattaatatatcggagggcagtttcatagtcttgctgagccagttcttcttccgataaattatcctgggtttcttcgatggtgagattgatatcaattttttcatcatttctcatgggaagttcttcctttctaaaaatatagtgaggcaaaattattcagtgtttcagttataatgaaacgaatctgaatagttgcaatcaaattatgttaccattttttcgggcaaaatacaaggcgtttgcgtaagaaaaccatctaatggaaattgttcaataaaaaaggaataaatgttgagaaaaatgcggtaagtgtgataatatattcagacagaaggctgaggcgttcttgaaaaagtaagtgttgataaatatgctgtgtaatttgttatgcaatttgcaatgaatttcaaaggcaatgatattttctttggtattggcatggtattagtatacgaggaggaaaagcatgatatattttgataatgcggcaacaacattaaagaaaccagatggagtagcacaggctgtttcagatgctatcatgaatttggggaatgcaggaagaggtgcttatgatgcatctttacatagtatgcgaatggcctatgaaacgagagaattattgaatgaactttttaatggagagggaccggagcagattgcgtttatgtctaatgcaacggaagctttaaatacggcaattaatgggatgattcagccgggggatcatgttgtgacaacggttatggaacataattcggtacttcgtccgttatatttaaaagaacagacaggggttgcgcttactgttttgccacttgatgagaatgggttgatttccagtgaagcttttgaagaggcgattcgtccggatacggaagcggttgtttgtacgcatgcatcgaatgtaacaggcacagcgcttaatttatataggataggagaagcatgtaaacgtcatggattacattttattgttgatgcttcacagtcagcaggaattcttcctatagatatgcaggcaatgaacattgatgcattgtgctttaccgggcataaaggattgtttggaccgcagggaacggggggaatctgtcttagaaagggaacaacaattcgcccattaaaagtaggtggaagcggaatccattcttttgataaagagcagccgcagtttatgccggaacttctggaagccggaacgataaatgcacatgggattgctggtttaaatgcttcacttaaatatctgaagaaggaaggcctggaaaagttatatacaaaagaagcgcttcttacgaagacattttatgagggagtgcgtcgtattgagggtgtgagagtgtatggtaactttgaccaagaaaaaagagcgcctgtagtatcgttaaatatttgggacgaggatgcaggaaaggttagtgaaattctttgggaagattatggaattgcaacaagagcaggagcgcactgtgcaccgcttatgcatgaggcgctaggaacaacggaacagggcgttgtccgttttagtttctcaagttttaatacgatagaggaaattaaacagggaatcgaagcaattcgggagcttgcatctgaataataaagataaaataaaaagagacagttataggagagctttctttgtcaaaaaagataaaatgacgataaaaaatgataagagatttgtaaagatgataaaatgcataaaaacataacgataaatattgaaattttagtgcagttatgctattctaaatacagtgtaaataatgaaaacaccataaaaaggaggatatgaaatatgaagaaatttacaaagatctttgcatttgcaatggcattgatgatggtattcgcacttcaggttccagtaagtgcagcggaaaaaggagcagtcatagaagcaggtgtggaagctccagaagcaacagtaatgacagatgtaacaaaagattattttgcattaagtagttatccatataataatacggcgagttttaaagttgttgttccacaagatgtatcaggtgttcagcttagattatataattataaaggtaaacagattgcatataaaaatgtagaatcttattattatgcatcgtcttatagatatgtagattttaatattaaaaagaatcaggcatattatgtaagagcagttagctatattacagtaaatgggcagacaacatacggtacactttcaagtcctagagcatttgtgaatttaaacagaaaggcatttaaatcaaaaacgaaatatttgaataataatacaaagagatttattattaagattcctaaaaaggcaaagtttaaaggaataaagagttttacactttatatgtctaagaagagagatactggatataagaagtataagaaagtaaaaccaggaacgactgttacaatttcaagttttaagaaaaagaaatttagaacggctaaagatttttactatattaaaatagttcctaatttaacaaagaaagtatccagtgatacatacgtatatgtatatcaataattatataataaataacaggggatgtctggtaatcgaatattttggcatctccagtagtgattaaaattaaaaaaatcccagtaaggggaaggctttttagcctttcctttactgggatttttttggagtatcaattagtcagcttttggacctgcttctgcgatattctttggcatgttaggatatttcttagtgaagttatcctggaacatcttagcaagctttttagcctgtgcatcgtaagcagctttatcttcccatgtgtcacgagggttcatgatttcagaaggtacgttaggacatgtctgaggaatgtctacgttaaatacttcatcatgtttgtactctacatcatcaaatgttccgtttaatgctgcagttaccattgcacgagtatattttaacttcatacggcttcctactccgtaaggaccgcctgtccatcctgtgtttacaagatatacttttgtgttgtatttttcaattctttctccaagcatgttagcgtatacagatggatccattggcatgaatggttcaccgaataatgtggagaatgtcggctgtggttctgtgattccacgttctgtaccagcaagtttggatgtgaatcctgttacgaagtggtacatagcagcgttctcatctaatctggagattggaggaagtacaccgaatgcatcagcagttaagaagataactactttaggaattccgccaacaccagggatctgtgcgttagaaatataatcaactgggtatcctacacgagtattctctgtaagagatccatcatcaaaatcaaattcacgagtttcgtcatccatgacaacgttctctacaaggcttccgaacttgatagcgttgtagatttctggttcgttttcagcgcttaagttgatacatttagcgtagcatccaccttcaaagttgaagattcctctgtcagaccagccatgttcgtcatcaccgattaatttacggttaggatcagcggaaagagtagttttacctgttccggataaaccaaagaatactgctgtttcatgagtttcaggatccatgttagcggagcagtgcattggaagtacgccttcttttggcattaagtgagtactgagaaccacagattactacctgtttctgttcatagtcaacgatgatagctgcttcagaatgagttccatcgatttctggaatacacttgaatccaggtgcaacaaagattgtgaaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtactgagaaccacagattactacctgtttctgttcatagtcaacgatgatagctgcttcagaatgagttccatcgatttctggaatacacttgaatccaggtgcaacaaagattgtgaaatcagcttcgccgtagttttctaattcttctgctgtaggacgaattaaaagctcatgaatgaaaagattctggcttgctaactcgttaatgatacggaactttcttgtacagacaggatcagcaccagccttaccatcaaagatgaagatttctctgttctgaaggtaagcaactacttttgaacggatagcattgaacttctcctgagtgataggaacgttaacgcttccccatgcaatgtcatcatgaacagaaggagtatcaacgatgaatttatctttaggagaacgtcctgtatatttacctgtagttacaacgagtgcgcctgtgttagagagtttgccctctcctcttcttaaagctgcctctgttaactgtgcaggtgttaagttgcggtaaactgctttaggattcacaatcccaagtttctcgataccatatgtttccattgtaatacctcctaagttatatttgaattaactaataccaatttttcaacaatcgttcctagtatagcaatgaaggattgaaatgtcaattattcaaaacaaataaaatgactaattgtgagaaaaaatattaaaaatatttaaaaatcaagggtatttacatatatcttttaagaaacattactgagaatttctgtttctttttctatttcctgtcttaaaattgaaaaattgcaggaaccaacattcagaactgattcatgaaaatcagaaattttaaaagcttttccgagggaatcagacatagtttgttttaattgatctaattcatagcagccgatgctgtaggagaggtaagttgtcggattttcaatgacataacgataaagattttgagcgctgtccttgtctataccgtaagtctgtaagtaatttgccagagcattttcatcatagtttttataatttacatacagatcgcagagagaggataaggatagcgagagcaggtcattatcccggtaaagctggcggagctgctttgttgtttgttcatcgacatttttaaattcaataaagttatagctgtatagctgtgcgtaagttccccagccttcatcatagccggcgcagtggagaaatgtccgaaggggagaaggattcgtagttaaaaaataatttgtctgatacagatgtcctggatagccttcgtgtgcaagggtagaaaataattcattagaatccacgcggcttttatttatgtaaataatattatctttggtgctgtcgattggcggtacaaggtagaatgcacaggcggaagtaccggagagtgcatcaggaacatttttgagctggcaggaaatattttttatttccggaaagtcgattagcgaatcattttttaacgtgttcataatttcttttggtgcagaaagagcaggagttgcagagagatattctgtatacaaatccttattctttgtagtgagagaagaaatatcttttactgtattttttaactgtgattctaaaatagtaatacagtcttccggagaaaaatctgtccctacattagacataagcaaaaatttataataatcctgcccatttttatattcgcaaagtctttctttagaagaagtattttttgaatcatttgtataagcttgtaaagaagttttcagtgatttatatgcagggagaactttatctgtaacaagcaggcggttatttgcaatataacttgctttctggtctttacttaaagattctacctcagttaaacggtcctcaaagctttggatgaggggattattttcttcacttgcatttagaaactgatcaatctgatcaatggtatcagaaattacaaaagaagggcttatgagacctgcatttctccgttcctgttcaaaatcaagaatctgagtaaaaagttcaggaacctggttgacaagagaaagataatcttttatgtctttttcgttatccagacggtattcagaaagcgttaccggaatttcggattgtaaaccgtttgtgccaagtggggaagaataaaggatgtatttttcgttcataatagattcgttcagataatcctgaaaaatctgccaggtaagtttttgcttttttgtcagactgcttgatggaaaggtataaagtttttgaagtaattcttttgaacggctgcagttcttttttaaagcatcggaagaaagatctccataggttggagagacaggagttttgattccatatgcagacggattcgaaagtttaaaatgaagagtgacggtattttcagcagcatattccttgaaacaggagttaagaaagcggtcaaatttcttttgctttaaagaagtttgcgtagaagcttgtccgcagccaaacaggatggttccggaaagcaaaataaaacagatgctggcaaatagtgtgtgacgatggtttttcttcataacggcctccttttatatcatttttatatcagaagatgaaaagtatttggtattatactatgaattatacaggaaaactattagtttttcagaaaaataaccatagacgaatattcggatttattttataataaaaaatgtttgattatagatagtacacctaaggacaggttgcacaggaggtatatagataaatgagtaagaaaccatattacattacgactgcgattgcttatacatcaggtaagcctcatattggaaatacttatgagatcgttttagcagatgcaattgcaagatttaaaagaaaagaaggctatgatgtacgtttccagacaggaaccgatgaacatggccagaagattgagttaaaggcagaagaggctggaatttctccaaaggaattcgtagacaatactgcaaaagagattaagagaatctgggatttaatgaatacatcctatgataagtttatccgtacaacagatgaagatcatgagaaacaggttcagaagatttttagaaaactgtatgataaaggagatatttataagggatattacgaaggaatgtactgtacaccatgtgagtcattctttacagaatctcagttagtagatggtaagtgtccggattgtggacgtccatgccagcctgcaaaggaagaggcatatttcttccgtatgagtaaatatgcagatcgcctgattcagtatattaatgagcatcctgactttattcagccggaatcccgtaagaacgagatgatgaacaacttccttttaccgggacttcaggacttatgtgtatcccgtacttctttcacatggggtattcctgtagattttgatccaaagcatgttacttatgtatggcttgatgcattaacaaactatatcacaggtcttggatatgactgtgatggggaaagtggagaattatttaagaaatactggccggcagacttacatttgatcggtaaagatattattcgtttccatacaatttactggccgatcttcttaatggcattagatctcccacttccaaaacaggtatttggtcatccttggttattacagggtgatggtaagatgagtaaatcaaaaggaaatgttatttatgcagatgatcttgtagagttatttggtgtagatgctgtccgctattttgtacttcatgagatgccttttgaaaatgatggtgttattacatgggatcttttagtagaacgtatgaattccgaccttgcgaatactcttggaaatcttgttaaccgtactatttccatgtctaataaatactttaatggtgttgttgccaatgctggtgtcacagatggatttgataagaatcttatggatgtggcattagatacaaagcataaagtagtaaaatgtatgtccaaactcagagtagcagatgctatgacagagattttcaacttatttaaacgttgtaataaatacattgatgagacaatgccatgggctttagcaaaagatcctgaaaagaaagacagactgtctactgtcctttataatttagtagagagcataacgatcggtgcttccttacttactccgttcatgccggaaacagcagaaagaatctttgcccagcttaattcttctgaaagaagcatggatgaacttgagatgtttggcctttacaagtctggtaataaggtaacagataaaccggaaattcttttcgcaagacttgatgcaaaagaagtacaggcaaaagttgaggaactgaatgcttcaaaacagacacaggaagcagaagaagagaaaaaagatgatgaacctgtaattgatatcgaagccaaagaagagattacatttgatgattttgaaaaaatgcagttccaggttggcgagatcattgcctgcgaggaagtaaagaagtccaaaaaacttctctgttctcaggttaagatcggaagccaggtaaaacagattgtttccggtatcaagaaacattatagtgcagaagaaatggttggcaagaaagttatggtacttgtgaacttaaaacctgctaaattagctggagttctttctgaaggtatgcttttatgtgctgaggacgaaaatggagaattatctcttatggttccagaaaagaagatgccagcaggagcagaaatctgttaatatgtagatttcgtggagacgaaaaaaggaaaaataccatatcccatctgctctgtagtcgctgtatttaagatgctcgtccgcatcttaaatacgctccgaagccgcatctgggatatggtatttttccttttttctgactattctaaatctacagttggtaagaatggggattctccagaagggagtaggtttggctgaattgtattcagttttctaaagaaaaagaattgttataagtttgattttgttccgttgcgctaaacgcttcattttgcctaataaaacaaccttgctcaaaaacgatttcgcaaggttatagtcaaaatttcgcagcgcaaagttacaaaatgcaatacttataaaaattctttacaattcagcataaaattttgtttcagcggctgaaggaatgtttattgctgaattgctaaaagattgtggaaaagagaagaaacttcttaattaagtattacattttgtgactttgtgctatggaattctgaccataggaacttaggactcatttttcctaagttcctgtttttctgggcagaatggaatgtttagcgcaacggaacaaaatgaaacttaattaagaagtttcttcttgttcatagtttggaatgcaattcagctaagtaatcaagctgccttcagcggcgtatgtttcctttggcaattagcaattaaagaggtatattatgatttttgatacacattctcattataatgacaagcaatatacacaggacagggaagctgtccttgcatctttaaaaggtgcaggtgtaacacaggtagtgaatgtaagtgcgagctggaaagatttgctggatacgttagagcttattcagaaggtttcgttta

SEQ ID NO: 460 - DNA, 14584 bp, Eubacterium hallii
tatttggattaataactgtcagatcatactctaaaacagcattacctgttttacacttaatcgttgtctttcctgctttcaaagcctgtacggttccgttattatcaacagaggcaacctgaccggacgaagaagaccagcgacatacattggctgtattcactacttcaacttctcttgttgtttccacaaccatctttgcacttgcgttttcaagtttcggcacatatactttacatttaatctttcttccagtacgagttacacaaacaatcgtagtctttccgctcttcttagcctttacaatcccctttgaagtaactgtcgcaatctttttgtttttagaataccatttcctcgcttttgaatttctcacttttaaagtaaactttttctttttagacaaagttaacttttctttattaaatcctacaactacaactttgcatttatatgttttctttttcgtttttgctttaatataggctgttccaccttttaatgcatatattctgcctttttcatttacagaaactatatttttattactggaagaccatgcaactgcccccttggcctgccgtaattttaactttttatttgttcctgctgtcatcactatgtttgtctcgctcagacgggttgctccctctgaagaacaactaaactgaaggaacatcgtgaacgttactaccaacactgttaatagcgtatataactttttatgtcttctcataattgttaccctcctcctgatacattcaaaaacgcttaatcacaacaagctgcgttttgtcttccgcaataaccgtaattacttctgatttatagctttcttaatattcatatcatttttaataaagtcatttacatatttaaaaagctttttatctactgaatcggtgtaatgtaactgatagctggaactttctctcatatagcgcacattcatctttctgtacttaatagcataacgatatgcactcttcttatgaacccatccgtttttctggaatacattcttataagtatccacatacgtcacattcttataaccggacttcttaacaagcttacgcaatgtcttattaaaacgaataactttactgtttgttaccgtatttcctctgtaacgaagcgtacagtacactggattgacagagagaagataaaaataatcttccggatatttactgataaaactctcatataacttccagtactctgtagcaagtgtttctggacttgccggagctactcgtcctccacccacataggatctgaatggacttacctgtggattataaatatcatttactccggaggcaaagacaatattctgacgaccggcttttcttgctacgttctgtattctcgttcttcctccgcgcaccagattatatccggttcctcgtcctgcataacagtcacgatacttgagcataagatatttgccctctactcgtgctttgttacgatattttgttccatttggggctctcatatccatgtcctgatagatgagaacggttcgggaatctcccacccataatgaaatcgtatcgtttgtatcaatatttttctttgcagcagcctgtgatgtcgtattgaaactaaataacataactgctgccatagctaatgccattacctttgttaataaacttttcttcataatgccttccttcctgtcttattcatctggtacatcattttataaataactatgtactaacattctccaaacagcagaattcgaaatactttgaatctgcgcagaatatactttgctacaataaatgatatgcctgttcctgacacaaaacataacataataaccaaaatatttggcatatgtaatatgttccatagagctaatcttgataccgtctgtaccgggtctgacaaaatataaatatccatactcgcatcacccagacttttcaaaacgccataacattttacattcttctccacaagccaaagagaaaaccacatgcataatattgttcctgaaacagaagtaataaattctcctcttcccatctgataatttactatattacatataataaatgcgattgctaccaaaataaaaatcaacttattctttctgatttctatgaatttctcataatgatctctaatataaattcccagaataaagaaaaataaatactttggtatacggaagctccagttaaatataaaggctgtgcatgaaagaatagcgcttgcaataagcatcggtaacagcactgagcgcctcagtaaaatcaatgcgattaccgacacccagaaaagggtatataaaaaccacatcgttgtattcggattatctccaagaatcaacttccagcttcgtgaaaaatcatagggattaatcgcaaacctgttcataaaatattttaaaggcatatagagaattcccataacaaaataaggaatcaagagacgagttgctctgctttttatatagtttatgtattctgtcatcttagaatactgaagaatctttacagaaacaaatcccgataacacaaagaataggggcatatgaaaactatatattatactgatcaacgcattccccggtacattacttactcccgtctgctttaaagcatgtcctaatacaacaagaagaataccgattccttttgcaatcgtaatctcgttataatattttttattttgttgtgttgaattctccataactttctttccttttattattcgttacttatcattccatgtaacttcttttctatctttatcgtcaggtgattatatcgcagaacttcttttaaaaattcaataacaacagaaaacagcagacagtctattactaatacaataacgatcagccaccagaatctgaaagaatatgagaagtcctcaaaccatcttgaacggataaagttatgaaataaaaagatattcattgagtatttacccagtatgcacagcatatcccgaagaatcggtatacttgcgaggaaaagataagtgaataaaataactgctaatggtgttacactatcggtaacattcagatgcacttttccaaactttgaagtcttaagccatacggttccaagaatgaacacagcaagtacacaaaactctgctgcccttgtgatcataagccctgtatgcggaatcctccagtctgcagccttaggaaataaatcttcctgtgcaaaccaaatacctaacgtcatagctggaagataatgtacaacactgctgctcatcggcaatgacaatgccattggcagaagataactcaatgcaatcgtaataaatgctccacatttacgatacatataataaagaaatggaagcagcataatctccataaatgcaagtccaagataccaccaggttccaagcaaggtcggtgttccaaaaatatgagccagccctgaaaaatcaatgagcatataaataattcgaatcatgccctgcttatatacggcaaagctttccggtgcccaaactttacatccaacaatcgcaagaatataaatcggccagaaaccactcagaatcttccacactcttcgtattgtaagccaggaaatattctgtctctcatatttattctgatcatataacttttttaaagaaatcgtaatgccatatgcacttaaaaatacaaagattccaacacagacttttgcccataaagacaatgttacaacggttccttttgaaaatggtgcaaacgataccccatgtgccttaaaattaatattggttacataacaatgatggaagagcattgcaataattgcaacgcccttcacgatatttgtatcttttttagaaaattgtgtattcatccgtacttcccctgctaaaattacttaacggagaatggatttccagggaataatacaggatctgtagggtcagtttttctggaattctttaacttacctgtagtatgttttaacttaacaataccgaaaggtccctttttatttttctttacaatgttaatccatgtacgctgtttttttggtgtcttctttgcaacatcataaacgatcttcgcatttaccgcctgcatacgaacacagtaagatgtattactgtttcctaacttattataataagatgcagataatgccttgttattaccatactttgtatatacactactgtgaactaatgtaggagttcctgcaatacgtgtagcccactgatagaaacgtgtattattattcggtactcttacccatctctttgcagctgtcttcattaagaagaaatgtcctctaggtgttccgttcgcctttgcagatgtagaacaaagcactgtcttcgctgggatgatatacttctttgtcttcttatcgtacagatagaatgtaacattatgcgtctttgtattgatctcgatcgtcatctttgtcttgatacacttgttatatccccagtctttaaataagtttgtggaaagagaaccgtcttctttaaaataatatttatacttcgtacttccaccggtatagctctttaacatcttaaatccttttgcaggagcaacaccttttgtaaagtaataaatctttccgccaactttcttccagcctgtaaatttactctgtaacagaccttttacataatactttctgcctgcaacaccagaaaatacacttccgttctgataatatacaccgttaatctgcgcctgtgcacctgtacttacattcagatattttcctgtaaatattcctgtataggcaactccctgtacaccttctttgtagttgtaaaactttccgtcctttaatgcaacgcctgtgtaaagctttcctgctaaataaagctttcctgcttcctcccctgtaaaattcgcttcagctgcctgaactactgcagggagattaacacttccaggtaatgctgtaaaattaaatgtaaataatgcagcacccattacaacacccgttaatacggtcttttttacgttagtaaatttcatagaatcctccttataattgtttatatgctaatacttttactttatcgtttcgtataagaaaagtcaagcaagtgtctttactaattattacgtttttttgcttacttgctgattcgctgattcttttttcctgcccaatataaataggcgcaaaatacaatcggtatagagtagataaccggaaatgcatatcttggatgtcctttaataaccggtgccagtacgataatcgcatcgctaagcaaaagcggcatcaccagcaaaaacatttgtggaatcttcttgcgtattccatgatagcaaagatagattaaaatcagattaaaaaatgccatacttgctataagcccaaacacaggcaaggtaaaaaataccttattaaatccagttctccatctatccagtttttgaatcatcggaacttcatgaacccctaacttttctgccaatttctttgcggagactttgtccggtgctgttgtatcataaacggtactgttctctaccagtggatagaccagataatagttctgattcattgttgcttctatataagtgactggatgctttaacccctgctgcacccatactttaagatacgctgtcagatcttttgtcgttgcctttttcttataggtagctttgacgggatctgaaatcttcggattataatacttaccaagcttattgtatgccagtactccttttatcgcttccttctcttcctgcgttacttcctcctcatgttctttcacataacgggcggtctgctgaaatggcaaggataatgcttcctgaatccctcctggttcaatgttataatatctggtcaaaaagttctgaacccctgaagagacagcaaccgaaatcagacacactatgactgctgtcataaaagttttcgtatatcgagtccgtctgctttcctttctgatgtggcttgtatcttgattctcctcttgatctgtacgctggtttctattctgtaaaaataccgtaattaaaataaataggatcatcggatagataacatactttccgttatttctaaataaaacagatcccattattgatacagctaaaaggaaacaatgctttttacttctccaatattcctgttttaataaaagtatgtacaccaactcaatgacaaatagcaatataaaataagaatatattgtatcctttacgatcattccgatatactgcgtataatatggcgaagaaacggcaataataaatgctgtaacctttaaccatgttggtgaggtaagctccttcattgtgtaaaacatatatcctaaaatcagcgcaaataagattgtttgaaataaaatatataaaaataagcccagatttgcacttccaagcagcaatcctactctctcaaaagctcctgccaaaacagtatgtgccggcggatgatgtgtcgtgaatctctggaatccaaaagattgcagcatctgattccacacatcaatacacatggtcgccggataagataataataaattcggcagccagcatacaaacaatactaaaacagaaactttaaatggatgcttattgtaggcatcacagaaaaacacttttttctttggcagccaatcccatccagactgtaaaaacagatcaagcaaagctgacatttcagagatgagccaggtgatacctgtcacatagacaaaagttttcaccatctgtcctgttcccatatgcaataatgcaagggaatttaccctgtaaaaactctctcccatcacccatacgactgcaatacaaaaacatataaaaaataatactggtgtcctatgtacttttgttttgtttttataaagatatctctctatgatacataacaagacaaataccatagttgccgttgccatcgtaccggtcagacttccctgaaaattataaaatatattaagcatcttactttcgctagccaaatgattcatatcctgtggaatatcaaaccgtatatttaatgctaacgtagcaagaaaactcataataaaacgaatgatcatgttttctctctcctcattagtcttttagaagagtatctcctctactcacgcttcttttctgaaaaaaacaaaaagcgtataagcttcaacataaacttatacgctttttaatatctttacaatcctttaatacggataataaaagaaaccttatgtttatttaaataactaaaagtcttaatcttatctgcagaataataacgtcttactcttcctctgcgagttcctgcggaacctccatctaaccaaagtttctgaccttcaccattcttaccaacgtaaatattagtgtgaacgatatctctccatccaataatatcacctggctgcaaattaacagatgttaattttttatttactttgataatctgaactttgcctctccaggatttaaatctcttatggattcttcctccacgagtgtaaaaggtctgtcccttcttcagcaccccgaattcctgcagacaccatgaaacatatgatgcacagtttgcctttcttccatgtttgatactagctgaaagagttggcttattatgacttccgtatgtaaaattgtattttgttaagtctcttccgactttctgacaagcatcaatccatccttctatattctgtgtataatcagatgcttttgcctgtacagttgttggcttaactgcaagcactgcgacaattaccatcatcgttaaaactaacgtgcggagacatgatttccagtttgcaaaatatgttaacttcatgtataaatcctttccggtgcggtgtttttaactttccgtaacacatattacaataattattaacaaaagtcaagtataaatttaataattctgtaacttttgcaacatttgttacgattttgttaacaaatcatcccggaaaggcgatgaatttatgtcttataatactaaattcaatattaaattctatgatcaaatgatgttgagggcaaaaatattttgaccctggtatcagcagcttaatgaattgctgttccctctggcacacaatcatctacaaagataatcttacatccaaaatcatctccactggctgcgataagcataccgttactcttcacacctgcaaacttcaccggctttaagttcgcaattacgataatctttcttccgatcagctcttctggtgtataatcgtcacgaatagaagatacaataattctttcatctaatccatcaaataatgtaagttttaaaagtttctttgcattctttacaacttcacagttaataactttacatactcgcatatcaactttatcaaacgcatcaattgtaatctcttccttaatcggtgcaatcgcattcctgcgagcttcttcttcctcagcagcctttcttctggcttcttcttccgcaacttttctctctgcctcagccttcgcttctgctgcaagaaccttctcttcttctgtctgtggagtagagaaatcaagaagtccaaggtatctctgtggttctacagcaaacaggaataaatacagtcttggtcccgctgctttaccaatcataagattatatgcgttcttaaagaactgtgcctgtgctgccttcttattctcttcctggaagtctggatctgcttctctaggaatcgtatagataaagctgttaagagcatctaaatcatattctcctttagcgataaagtcatgtaataactcaatctccttcttctccacctcattcagtgtattatagaaatcccagtttctgtatccaagaagtgtattcatgttctctggtgaacacttctctaaccagtacttcgcaagctcaagacgctctgcaaactcttctttcttatatggtgtaccaatcttttcaaatactgtctcaagcatatctgcattgaaatctacaacagaaccaaagtttacaatctgctgcattggtaccggatgaatctcacgaccctcgatcatacaattatgcatgatgccttcaatataatcataattctttcccttacctgcctgatataccttaagcatcttatcaaactcaaaatactgacgtaaaatctcgtcatcgaagcagaagtcaaatgccttattcggctctgacttagaataaagccataaaatcatctctggctgataaatcttaagtaatgtatccggtgtaagattaagacctgtagaaccagacatcttaccggttgttcccttgatacctacgaattcgtatcccttaaacataggtgcctgcgctccgaaaatcttcttcgcgataatcttacttgtatcataacttcctccagggctggcatgatcctttccgcccggctcaaagtcaacaccttcgatcatccagcgcataggccagtcaatcttccatgcaagcttacagttaaagtccttactgaaatcccatgtgcccttatgtccacacttacatgtatattcacatgtcactccatcttcagaagaggatatgatcgttgtttcatccttaccacataccggacagtaaatacttaccggataatatgcttctctctcttcttctgttgctacctgctgacggaacttatcaagaatatcaaaaatctcttttctcttctgtactgcctgaataatatacttcgcatactttccgctgcgataattctcactctgtctacggaaatcaacctctactccaaaacgggaaagagatgcttcaaattccttttcaaaatgttctgcataagaagagcagcatccataaggatcctttacatctacatatggcttaccaatctcgttctctaactcaggagctatctccttaacgttaacaggtacctttctgaaacggtcaaactcatcccatgaaaataacaggcgggctttctttccctgcttgatcaacgctttatatacaaaataacttgtagctatatctctgaaattaccaatgtgaatggatccggatgggctgatacccgctgcacaaacgtactcttccttgtccggagatctcttaataatatcttttgcaatcttctcagaccaatgcattcttcttcctcctacttttcctgtactgaaatctgtcttcagcaccagtgtgctatctatcttcattaattataaaggcttttaagggcatctgcctcagcccatagtcaataaaacattatagcaaaccctatacgtcttttcaagaaaaatataagaaaatcaccgaaaaaccgtactattcaccccttggtccctcgatatatttcaaaaatcgtatgcaatctgctattccacaaaaataactttctgtcgcatactctgcctctgccgcactctgtgcctcaaaagcctcttctataatctctctctgctcttctgtcagattcagcgtatcaagcttcgcatacgcctcttcttcctctcttactaaacgcctgtacgcttcggaattcttccgaaaatctgccatgttctcattacgaaaatggtctaacgtaagccgaagtctctcttcccatgaatctataacattcccttgcaatgtttccctgcctttctgcttaagacacaagctatactaaatttccataccaacttttaaacacaaaaaaagcataacacagcctcggattcgtgtcaatattttactttgaataattatttttacttacgcataaattaactatttactttgctatttttaagaatttttcagcactcttgctacgagatacgcatcccatccgatataatgcccatttcaacaaataaaatacaaaatattcattgacataactggtaaaatcctttatactgatatttaccgtgcagctgggaagttagcggcgtcctgtacctgaaatccgctatagcaggagtgatggtcagcctcggatgtcttattgatggagctgccctttataagtggtgttgacaattgggtctcgcgcaacaggaacctctgaaccgtgtcaggtcgggaacggagcagcactaaggagtttctcctgtgtgccgtgagggtgcctggttcgagctaactgtagaggtaacgtctgttggtaagcatacaaagctgaccgcacggttttaataattcgatttttatattcacataacagaaagcgtcacatactcgaagtttttaatcacttccggatgtgacgcttttttaattattttcaccttattcttcctgcatctgctttctttttctctttttttctttctgaatctctcttaactttctgaaaaatgcagaaagcatttccgaacattcctcctgaagtactcctctttcaacctgcacctgatgattaaactcctgcatttcaagaagattaagaatggaaccgccacagccggccttcgcattcatgcttccaataaccactctggtcacacgtgcctgcacgatcgctccggcacacatctgacaaggttctaaagtaatatacatcgtacagtcttccaatcgccagtcaccaagctttttacacgcttttttcatagcaagaagctctgcatgtgcaagaaccgtcttatctttatttcgtttattatatccccgggcaatcacctttccatcatggacaataacacagccaatgggaacatctccgattgcttccgccttctttgcctgcttgattgcctctttcataaacttttcatcttcagtgtattttctcataaaatgttctcctgtttgccagttactcattcctctaaaaataacggcctttcctgattatttactccctgccctttaaaagataaagccagtagccaaaattgcctgttttcattctattctctgtcagcgataaaaatatcgggaactgataaagctccgccatatatttttccctattctcataaataccaggaactccaacacaatatcttttttctcctgcgtatcttacctttcccattaacaaatgcttatagcgttcatatccttttaaaagaaattgattatctgctaactgtctggcttcttctcccaacttttttagctttgctattgatactttatacccttcataaaaggcagtattaaaaatattatccacaggagagtcttgttttacagagtttatccacattttttcaaattcatccacaggagcgtttgcctcttctatgtctgtatccatatttacttccatattatttaacccagtattgcctatcttatcattgttatctgcagcaataaaattagctatattctgttcttgctccttaatattatctgtactctctgcctgattgctaacatctgtatcatctgcattctcaatctgcttactaacatccgtatcatctgcattctcaatctgcttactaacatccgtatcatctgcattcttaatctgctcactaatatcaatatcatctatacgctcatctgtattttcagccaaattacgcatagcagtataatccacattttcatccagattgcctgcattgatatcattaatatcatcgatattatctgcatgatctacaggttcttcctttttcttccactgcagggattccaacacttctacagggatttcctcaccaatccagacacttccataatagtattcttcctgataatacaacacaacacctgactgtttctttatatcgaaaccttccggaagctgctctttagaatacatttgatgaaattcctctttatcttcttctgttatgatcgaatcaagctttcggactccccagtgttctccctgcttttcatagaaacatagttttagtttcatcccatgtaataatcgttcatcgtttatctgaatagtcagcttaagaatagctgatttttgctctgccttaataaatccaagacattcttttttttctgacttttcataacgatacagataagaaagtatccgttgataatctgccatgatgatactcctttttcactaatgtattccggcaaactacttttatgacatcagtgtgtttatcttccaagaatatctgatagctgtgcaaattcctccaaagaaagtttttcccctcggattgtcggagtaagccccatctcctcaagcgccgctaccgttttttctttcggtatacgcagttcgctggaattatacagtccattctgcaatgtttttcttctctgattaaaagaagcgcgaataattttaaacataaaagaggcatcatttactttcaccggcttttcctgatagcgtgtcaggcgaataacggctgacccaacggctggccttggaataaagcaatttggaggcacattagctacgatatatggctcagcgtaatactgcactgcaagagaaagcgcgccgtaatcttttgttcccggtcctacctgcatgcggtctgccacttccttctgtaccataactgtaatggaatcgagtggcacttcactctcaaataatcccatgataattggtgttgtgatataatatggcagattggcaacgactttaattggcttaccaccgttcttttcttctgcaattttacggatatccacttttaaaatatcttcatttaataccgttacattatcatattcctttaacgtatcttgaagaatcggaatcagctttgtatcaatttcaacagcaacaacctcccttgccgcttctgcaagatactgtgtcatcgttccgattcccggaccgatttccaacacaaaatcatccggaccaatctgtgctgctccgataatcttatcaagtacatgtgtatcaatcaaaaagttctgtccatattttttctgaaaattaaaaccataccgctgtaaaacagcaatcgtctcctgcggatttcctaaattcgccataaaacctccttttgctgtcataagattcaactttcgtctttgaatatgttctatgacaagacgaagtctttgaaaacagaatttataataatatccttcattgctcctcgttgccgcccaggatttctactccactatactgtggcaatgcgtgcaaatactcgcactgaagaatattattataaattttgttacagaagattacggtgttcttgcaatagaacattcccacaaaacacaaaaaatcatttataaaatttatgacatcaatcttatatttgggaaatcaatactgaagtcttccccttaaatttttacttagtttctctacaataatgtaataatacatgaaatagctatttcattcaagagacgaaattgagaaaggggcaatatgtaaaaaatgcttcgtatcactacgtccaaactgctcaaccgcagcttgaacttgctctaaggcgcattttttacatattgcccctttctcaatttctgtctttggctaaagaaaaaatcactatataatgttgaagttctaatgcatagtttatctcagtcgagaatactcccattggtttcattcatctcaaagcagccaaaaaacagaactctgcttgtctaacgaattaaaccatataatctctgagcattttcataagttgcattttctacttcttctgccgtaattcctttcaatttcgcgatttcttctataactaacggcagatatgcag

SEQ ID NO: 461 - DNA, 14488 bp, Eubacterium hallii
gtgtttttataaccatttttacagttgttccggcattgttcccgtaaaaatctttgttattgagcaggtcagaagatgctgcatattccagataatttcccttgtttgcggaagtaggagcaaaactgcttgtgacatctttatcccctgcataaaacttaacggaatcaatcgtcagacaggaatcaacagcatccttgattacaaccttggaatactttgcggtagaaggcatgttcttttcaatttccttagaaacggtataagtgaatgtctcatccgcattggtaagtgtgttactcaggacattcttctcgtcctcatcggaaacggtcttcttcgggtctggatcaggattgtccgggtcaccgatagggacttttgaccagacggtggaagtgttctgtgaagcagagccataatcactatctgttactgtgtatacttccttcttttcatcatatgccagttttttcagatatgtcatgcttctttttgctgcatttggaatcaggcggtatttattatctgcggtacgctcatgtccaagccagctataagatgctgcatctctaatctttactttaaatgtaacggttactttctttccataaaatgaagtatcatttagtacatcacttgttgcactaaatttgatattctgtcctctggaataatctgtaaatagagatgtaaaatttttccctcctacatctacctgcagggaaccagccacataactaagcccagaatccagcgtatcttcccatgcatacgaagatatagcagtcttcttttgttccgtccataaatttgataaaatatctgttgcataggtcggagtagtatcctcgtaacggtatgaataagtatcccctaatttataagctactgctgatgttttttcattgctgatccatgaacttccactctggattaatttcttcgggatatcaggatttgcatcatcttcaaaagaattcatcgcccatggggctaaatcgaaataagcgatagctgtatgacctgtccagccatacttgatggacatatccgtcatattatttacataaagtgaaatacatgtcttatcaaaagtatctcttcccatacccgaagaagcattctgatcttttatggatttatatgtccatccatccggctcacaccatgtatttccatcactaccaccaatataggaagctttagagatacattctgtcccatctgtgatagccacatactggttctggtcaatatcctggaatgtagcaaatccggtaaatggagctttggtattcgttccattatataaaaaagtatatttaaattttacccacttaaacccggagaacatgacaactcccgttttcttataagaaaaaccaatggcataaccaagatgtgcggaattgttatcatgcccgaacatatctgtattagatggtaatggttttgattcattattctgcgttttccagtcggtcacttctattttaagatcgaccgactttccatttgccgtcgtaacatttttatactttacccaaaaatcagatgggtcatgattttttgcgtaggcagcaaaaccatgccatttctgaccagcatcggaattacctgctgccacctgctgtgcattgaaactcttattgggttcatcaccattactgtcactgtctgccataaagttagggacatctatctggcttttcgacacatcccggctaaagttgttggcatactttaatcccatctttgatttagggctaatatatgcaccttccaacccggaggctgccattacgcccaaggaaaacactcctgttactgccattgctgctgcaaacagaaagaccattcccttttttaatatcatttttatcttcatagcttctctcctcatattttcttattctatttatatatcttcattaattgttatggtggtcctcgtatcatagtataattacccttttccatccctaaaaatggacacaaaaaaagacattctttcgaatatccttttccgtactcaatgttctattttttgtatttacttttttccaatgcattttgctctaaacagcctcttaagcttttagaattcggttccagttaatttggttgactactccccggatttttaacttataacgactgtttttatattgctttaagccacatctgacacatgttcgataatttctcacaccacttgcatttactgaaactaactgccattttccccatttgtgtccaataggtttacccttcgttgttgtttcttttttaccgcaacgttcacaagtcttaatagtcatctctggagctgtacaacttgctccataatgcgtaacaccaaaagcgtgtcctttcgctggaattttgttaagtacatgtgtatagttacagcgagaacaacgttcccaatttaatccattagatgtacaagtggcttttttgatataacgctttaatgtatgatttttctttttaatcctttctgttttaagactcttaccacactttgtacataattttaccctcttccctgcttttgtacaggttgcttcctgcagtgtttcccatttagtatttttgtgtgaacacttggcgaaagctgtcggagttaaagtgatgaaacacattaagaaacatagtgttagtataaggatttttttcatgattaacatcctttctgattcatatttaattaattatttttatatttcgttttatgacatctggaacatgtacgcgaatagcgtgcctttcctccattgattgaaactaactgccattttccccatttgtgtcctaaagcttttccagtagaatacgattttttatcgccacaacgtttgcatactttaacagttacccctggagtgttacaagttcctttgtaaacggttgttttataattatgacctaatgcagggtatgatttttctgcgacactatatccgcaacgcttacacatagttccttcccatcccctattattacaggtaggtttaatatagatgtgtttataagtgtgacctagtttttttacagaacatgtctttaaattttttccacattttatacaaactttcacacattttccgtttcttgtgcaagtgacttccttcaagacaactaactttgtattcttatgagaacatttagcgaatacagacgctggtgcaaaaacactaagacacatcataagacacaaggatagagtaatcagttttcttatcgtagttgcttttttcatataaaaacctccttttcagttaccattttttgtaaggttttttcggtttcgtttttgttgtccccatattctgtattgtgatctgatccatttcatctttcgtgtatttctttgatccttttttgtaatgcatacgacaccgataaagctgtttcattttatattttgtatagaacactttacctcttgatgtagcagctttatacagatatgctgtatcaatgactttccatgcagtttctctgacataagttttcgatgcctttttagaacttgtaaatgttttcttacaaggaacccaacctgtacacgtaggataactatatggatctgttggatacataaaaacattatcaactactcttttttttgcttgtacagtagatgcaggggcaaaaaaggtaaaacacatcatcaaacataatgccagcgtaattaaactttttacatgaactaactttttcatgattaaatactcctctcgctattaatgctattaccattgttgatatagactaaaaagtttcttagtcctaagtccagtctatcctcctttctatcttcaatttctttttaaaccacagtcagcaatttatttttctttcatataaaaatttctaaatctcttcttatgatataaatattatgaagaagaaacaggcattatcagcagtgaaactttgcgtgaaatgctgacggtagattaaaacctgagaataatatatattttttctcttattcggattttttactgaaaaattcataaataaatcctttccacatctaaaaatgggtacaaaaaaaggacattctttcgaacatccttttccgtactcaattttctattttttaatagttactttttttccaacaccttttgctctaaaaagtctcttataagcttttaactgtttctttggaactttaattactgcttttttattaagtcctttaaatgcctgttttccaactcgactaccagttagcttggaagtttttactttaattgtccgtaacttagaacatctataaaatgttctttttcctatactgttaacatttgtacctatcgttactttcttcaattttttacaattcttaaaagcattcgctgcaatccctgttactttatatctttttccgttaagctttattgaagatggaatagttacagaaataatatttttcttaacaggttttacatactggactgtctttttagatttggaaataatcttgtagtagttccctttaattttctttacctttgtgacgctttttttctttcctggtcttgtaactttatttgtcttcatatttttagaccatgtaatacgaccattttttacttccagtgcatatcccccggcataacagtttcccgtatattctttaggaatatctgatttagatttccaatttggaagggacaaaagggtatctgtatccacactaattatatcagaaaccacatattttttagttgcctgtaaacttcctactctaactgttactgtggcaatcccatttttctttgctgttatatttccattagcatctacagaaactatagatggattagagctgctccatgaagcaccatcattggaaagtttacataagaaacgttttgctccagtgacgggaatattttcccacacacccggatgtgccttccttttttctccttttttaatcacatcataggcatatttaggggttaattcatttttgtcagcgtcaacaattaaataggtattcgatgaatcaatatataaatccatctgagtacgcactgtttttccattatttttatagatatcataacttgttgaatcatatgcaatccaattgctgacaaaacaataagttacattatatcgacttccattattcaattctctgggaatatttttaggattatctgtcgctactatacctattcctattgtcgaggaaatattactatctttgtatagaaattttcctaattctgacacatgttttgtgatagctctttttcccttagttgtttctttccatagattatcctcatattcatcatatccatctatatcccccaatttaaaagcacccttaatcgtatatttatcattatagatttctggattacttacagtagcattacctccctgttcctgtaatgctatattcattgctgcttctgtaagagttgcatccatctttaaatcctgtaatccattacttcgtctttctttgtttatctcctgcaaaacttgctccgcaatcccataaaatttttttacatcaacttttgctttcaccgttgcagcatttgcatgaattgttcccagtcccattaaacatacaaaagcaagtaatgtcagtaacaaatgccctttcttcatcgttttttctctcataacttcctcctgttccgtaccgaatttcggcacatttataagtagatttgccggagattttcggtatatttatctatcatatcactccatctccaacttttatgtttagctttaatatatcacattatttttcactattccagtgttccagtctgcttttttcagaatcttttttacgtttatgtgtaccgaatttcggcacatattcctgacaaaattctatgacgcaccatgtcaaatctatacagaagattaacacgatacacccgtatagccaatgcttaattttccacagatcataaaaataagtacacaatagatataacaacaaaaatatctgtaaatgacaaaggctccttctttgttcactattctttatcgctaaaagaatcggtgatatactgaccagaataccgaccgttataattagtcctctttttaatgacagaccttcacacattacatctgtttttatatcctcgattgctggcattaatgtcataatcgaaaatcgaaataaatgaaatgcagcactcattcctatcccgatggatactaatattctgtctgttatttgtacaatgtccatgccatcacctctgctttttaatccgtgccgaatttcggtacaaaaaaagcagaagattgtgttccttctgcttttctttcttctactatttaaatctaatttactgattttattataacacagctctttttacctttctactgacacttactgacacctatttcttctcataaggaaagaattcgcatttaatctgccggatagatacaatcatttttatgaaatcataaacacttgtaagttcaactttatatgtgcgaccatacttgtcaaacatatcgagcagaaaatagtctcctgtatcaatgattatattgttaaagacgttctcttccgaacatctgtccatgacatcttctatttcatcttcaatgctgtttataaaatcatacattgggacattaatcgtccgaactgggataaccactcttcttgttgcatcactgcagctaagcaatatttcatattcgcacttatattcccctgtccccaatattatattatctacatattcatttacaatggtcggtttatatttactgctttcttttatatcgtaaataacatagtaatctatgacttttctctctgcaaaatcctgttccatcaggattactgtatggggatattccagtaatgttgcccgttttctgatctcaaaaaattgttgttcttcaaaatgagattctatctctcccgtgtccagaaattttctccccacctttaatccccatatatcggggattgtatattcattttttgtagttaattcgattgtattttttaatggcagtcctgcttcttcaaaattttctcttgctatccctgtaatattcatgtctctctcctttttaattgtgccgaatttcggtacgttctaaattctttggaaattgtgctttccatatatcgtattcttcctgtgcttctgatacaggacaaccgtactctatgctaaatctacttccattatatccagccatcctattacagttttctaaaaaactggcatattcccttgcttccatttcattcacaaatccagcctttaacttttttattccattatacttctcatagattttccattgaaattctcccgttgtatttcctttcttttttatatactcttcttttttcgttgcccattcttcaagatattctatcagtttccatatatctgtattatctatgtcaaaagttaaacgtatctccctatctgtcttttttatatccatttcgtatttttcttcaagataaaataatgctctgatagcatctttttccgtctggatatctatatcgtttaatgctgacatatctatatccagagcttctgcaatcttcctccgtatatctgtttggggagccatcatatttttttcatattttcttatacgggaatcctctgttcctgcagagaatccaactttttgtcctaattctctttgggttagttcccgtaattccctgtactttttgattttttctccaagtgtcatcctctttctccttcttttccctcctgatctgcacaaaaaaagcaggtggaatattcccctcctgctgttatcgtcagatgatttttatttttctcacaatatgttcacaaattactgatataataaaaaatacagaaatacttattctttgataagtttcttatactttcctcttaaagaccagtccggcagggctggctttctctctatgtaccgaaattcggcacatttatttttgttttacttttatttcttcttttcgttcttcaagcagcttctgaataaattctatcatttccagattactttccttttctataagataagaatatatccttttcctggcagcaagcgttgtttttttatctataatctgacctactaaaaactcttccctgttttttacaggtataaaagtcctggcataattttttgttgttttttttaatccctcgactttgataacatctttgttcattaaactttttataagcagatggacagaactgtctttccattccttttccttttcttttgacctttgaatgatttctgatgtcgttaatgcttttccctcatcccacaatacttccatgatttccatttcacttttagttaatcttgttttcattattttttcttctcctgtacatttttattttttattaaatatatttatattataaattatattttaaaaaaagcaacaaaactcagaaagttattgttgctttactattctctatatagttgacactattccgtataattgatataatatcaataaacaaagaatcagcaggggagcttcggtaagcttcccattctggtaatctccagaataggaggcattagctccctgctggtattgggagcaagaaaacattccgtttttatgctttcctgcctattttattataccatagccctttttccctttccagtgacatctactgacatttttgttttctatatctttctcattaaaaatgtaccgaaattcggcacacacaaagtgtcatttacattatcttttacgattatatagtatcacagtttcccgaaccattctactgacacttactgacacaaaattttttaaatttgtttccataacttatagaactgccgcaaaaataattatataatacctatgtaaaaacactctctttacgtttttattttatatgtctttttaagaaagccagtcgatttagactggcttttatataagtgcagataaaagatttatgtaatgcagcttttacctagatgcttctgccatgtcatgtaccgaatttcagcacattttagctaaataatcctttaagttcatttgataatcttttgtgttcatttgcttttctcttttggcttttatagctttacggtattcggcaggagtcatacctatattatttttgaaatccataccaaaatgtgtgtggctcttatatttcaatttaacagcaatttctttcatgctgtatgttgtcgtagccaacagtctcttggcttcttctaatttttttattttggagatagctgcaggtgttgtgccataatatcttataaaatcccgccggagcatctgtgcattaccatcatatccaaacttgttagctaaaaattccatttgcgggctttcgaggtaatgcttttggacatagctgtttactttttcgcaataatttcttcgttccgaatcggttaatcgttcgctggtctggtttcgttctctgtgtaaaaggatgagcagcatattgatcaggctttcgcaattatgtatataaccaaattgcttctcgttaatctcattgatgagcattgagacgattttcatagattgatttttcaggcagccacgcatgattgtttctgacatagaaagtcctgtaaaagtaatcatgatctgtggatattctgcatggactgatattttatcccttccagtagctccctgtatcatgacatactctttttctgacatgaatatctcctcaccaaacgcatttataatccctctgccttgataaaaaattataaacaatacttcatcgtttgcaattttgacatcacttatcttttttttgcccatctgaatgtcctgtacatgaactgttccagattctaaaatcttatcgctcattctacctacacctttcttgtcacttccgaacgtgccgaaattcggtacatttcaatcatcctatccatctatctatccctcatacctgtttctctatatactgatagataagataagatatatatatatatatatttatatttctatttatctagcgtacaaattttgtgtttctagaaaaccaaattttgtgtttctagaaaaccaaattttgtgtttccagaaaaccaaattttgtgtttctaaaaaaccaaattttgtgtttctaaaaaaccaaattttgtgtttctgaaaaaccaaattttgtgtttctgaaaattataaagtattatccgtcagaataattatgtagatcatgctttacctgcattgcataatacaaatctgttgtaactggagcattatataaggctgttagtaagtaattattcggtctgcgaattgattttatactttttcctatgcactccataacatactgaatatgagtaagattaatccttttcaaacggtttattacctcatttagaggaatcatatctccagatatattaatacactctttttgggacgcataaacatttaccattacttctactatattatcaataatattcatatcatagggagattgccgtaatacatcataatctatctgttttttaataatttctctatatgctgcccgtttattttgaagactcggcatgtcaccgtcatttgtatatactttttcttctttatcttcatagaaactatgtagttgatctggagaagcaggaacctctttttcttcctcacagtatgtatttaccgttttcttatgttctcctgaagaaaagttcatgacatataacatatccgcctttccctgtccctgcctttttcttttaataagacctacctcaagtaattgattcattgcattagaaatcgtattaggacttttacccattttttgagcaatatcattacggttgtagagaatatatactctgttcgtctccttttcaatccagttattttttttagacagagcaagccgggataataagattccgtacaaaagctttgctgtgtcacttatctttttatattcttcatcttcaagcaatatcgcagggatctgataaaaacgatattgttcaccttcactcccataaaaataatccagatttaccataatgttttcctctctcagtcttttttcatcctctacgtttctacaatactcactcttattccggtggaaaaggtgcttcctctgttacaactccagatgcctgtttcttttctttaaaatctattacatggtaatctttaataaataattctactgtatagtatttcacaccatctttttcgaaattattctctctgttctcaccacatacacaaatccgtccacctttttttgcataagtgcagattccctttgcagccgaaccaaaagcaacacagttaaaaaaatctgtatccttttctccttctttcttcaccctttttctggcaacagcaagacggaaacgtgtccagtaattctctttatcatccattgcctttttatttaatactaaatctgtacagattcttccaagataagtacattcattcatatcatttacctttccttttgtattcagataatcggagtaccttcattggggatttaaggtactccgttattacacaacaatcgattggggatttcttgttgtgcaaagcccacctatgcttttgcagccacgaacgatgctggcggggaaagtagcatcttcgtaggtgggatataccaaggatattctatatctctggataattgttaagacctcttttgattcctcactcttcgtaaatcactgtatctgtcaccaaactatgtacaacaaaacgataggaatctcctttttgctttccagagcaggtggataatgtgattatatggtctttttctgctggtttctttttaataggataatatgcattattattaactgtcattgtcaaccagtctacccacttattatcattcccatcatcagaaaaatctgtattgtatgttgcacttttatccagacagtcatacacgctatatattgtgcattttattgtcttacccggctgatacaaatatatcttgttatgctttttataaaaatcttctgattcaaaatcatgaagagaaccaaacatagacttgactctcatattatgtccatagataaccaaatgacggtcatcaaaagatgtcccaggctgaataaagatggaacctgcatagctataatcaccctcataatttttatggagatattcgttccattcttttccctttaagactggataatcaatcttcgttccaggaacttttatccatcctacaatatctggattggtacgctttaacttcttccagttaatatgagggttctcatccttggtcttctctgtttctacgcttgcctgcagattttctaactcctgctggtttttccaaagtggatattgttctttaaatgccattgcaagaaatacgattgctgcaatgatcaataccactataaccatacggtaaaagaaatctcccagccttcccatagtgttttcctctctttcttttcaattgcggggatgctggaaaggcatcccgcaatgaaagtatatgtatacacacataaaaattttatgtgtgcaaatcctgcctgtgcttttgcagctacggacaatggcaatgtttcttgcctttccgcaggcaggattgacttattgcttttcacatcttattcccataaaagccattagttggctacctattcttctggctctccccagattgcgatatactcatctgcatccagatattcttctgaccattgctgagcctgttccacagacatcaaaataaatttttcgccagcacagccttgtcctccataagagtcaccaaaacttgaatatgcaccaccatgagcataaacaaaatattctcctgttttctttttatgaagtgtctgttcttcgaaataaaaatctccacgggtgtacccattatcccaagttcctattacctgtgtggtatctgtattatacattttcccattaatgattttctttgccatgctttatcctcctgataaattttttacttaaataactgtatgatacatcccatttctcctgcacgataaatactaatcttatccgcattaaattcatgggtgagaaaggaatcgtcatatattcttaaccaacctttaaattctgctacttttgtataatgttctccaatctctgcatcggaatcaacgatataagcgtaatagtcattatccatcccaaagtgtaaggcagttaatcttaatccattgtcactggaaccagcaaggattaaattagctatatcactcatcccgatatacttcttttcatattccttgtaacttctcatttcccctcgcttctatatgttctgcgtaccgaaattcggcacgcagaattcattattcctatttcaaatattccaatactacgaaagcattgtttttcatatactgttctttctgctgatatgttgtattgtgagcaataacatctgcccagcttactaatatccacaagattcctaatgcacataaaaaagttattaaattccccgcaaacttcttcatattatcttacctgctttccttcctctaaaaattttccatcatcgtcaactatatcggataaccagttcagtaatagatctggtgattttagtgtagaaacagataagtttctgtttaaatattgtgccatatcttccatggataagttaccaagccacatctgacgggttattcccagtacagtttcctttacagatagttcttcttccgattgttcttctaagaccggaatatacatttcttcctccggggcttcttcccctccatcatcttcctctactatggtgtccattgggatataagcctgttccatagtctcttgtttactatcgggaacaagaggaatatcttctgacagaacttctggaattggtgttttctccattttttcctcatcatgttcttccatgatattttctggttcctcatcttcttcttttcttgggcagtatgtattcaataattttacatatctttcccatgagattgtttttccagaaatagtaatcgtcttgcttgtacaggaaatgctaaattcaccctgagtaacagtataggaattatatccaaattttccttttaagaatcggactattgcattccttcctactgttgatttatcatattctgcaatatccaacaatcgaaatgacactttaatctccacagaattaggttccagattttcctgtcggtacttttcaatctcaacattttgcgtgattccctgcccaatcacttctttttgtgattcttctggcatttttgagagtgtcacagcagcagatttttctatctccccatttttgaatttttccatggcttctgaagtaaggttattagaaatctgcttatattcctgaattgtagaacgggcgattcccatttttcttgacagacgttcaat

SEQ ID NO: 462 - DNA, 14419 bp, Eubacterium hallii
aacatcttgaatcttatgccatgcttcagcgtcttctatcgcatgatattccataaagataaacttctgtgctttctccaaatccttaagctgtgcctctaatcctttcactgcttcatcaaaatacacaatatccgtattctgatatattggatactgcgaatttctttgtatgtaacttgctatatttcctgctttcggaattgtttcttttattttgctcaaacactcctgactgtccggaagcattggtaacaatttgctatcaatttctgcatatcgctcacgcattttatgtgtgccaccattcaaaccaatcaacaaatacaggcctacacccataattgggaaaattagaattaagatgacccaaggcattttcatagaggatgtcttatttgatgcgtacaatcccaaaaccaagatcccactcaaaatccttgtaaataaatttatgatttctgcatattcattcaagcgtgttacgatagtaataataaaaatcacttccagaagaatgcagattatggaaaaacacagccgttttaccccattttttgtttttgctttgccctctaaagtatcttgtttcatatatattccaccttcctacttgctcagttttctccctaaatttcgtggaacataccaattttgtcttttattctctgcatttcattatctgcttcaatgatagctcttgcagaatgaagtaattcttcacttatctcatcatagccaggcatttcttcaattccttttttatagcgaagttgatgttccaatgttgcccagaaatccataccattggttcgaatctgtaattctacacgcataggtgttttacccttagcaaaaaatactggtatttcaacaatcatatgatagcttcgataaccattcgattttggattttttatataatcttttatttcaataactctaatatcatcctgttgggtaatcaaatctgatatcatataaatatcatcaataaacgcacaaactattcgaacgcctgctacatcattgagatatgtctgtatattttctgttgtaaattcatatcccatcttctgcagtttatcgtaaatactattgggcttcttaattcttgtttttataaaagaaataggatttcgattgttctcaactgaaaattcatcatccaaaacctcaagtttagtttgtatctcccgaatagcacaacgatacatcatcattaaattataaaattttgtagcattatttaaaaactgtagtgattccggactgttcatcctgagtttttttacttcatcttttgtcatggaactttcctttctacctcatccctgatttcaaaacattatttattttgatagttgattcgttctccttgaattactggataacaaatcattttatcactatccagattttctacatgcatatctactgcactgatctgatggttttcataagtattgtaataataaataccttttgtaacattacaacacgacgtatacaatgtgatttcatattttccatccgctacttcgcaacatcctcgttgctgatccacagatccgagaatgtgaaagaattggctaacgctttcttcctctgattcacctgaaattgcatttacctttgtaaaagctacacgtacaaagcgtgaggaagatgagagatctcccggaagacctaatcctcccatacctctactatatgcatcaagagccaaattttcgcagaaagtatttctgggctgtttaggagataaatacatataattatttagttgaaacatctgctgtggaaatggcggattattcgtaagcactcctactggattgtcataaatatgcaaaccatctgacatagattctaccgtaattgactcattctcatcagaaatgatccagtgtaattgtgctaatggtaattgctcgctgaaaggagtattaacaatattaattcgttcaagaagctcgcgaacttcaactaaagaagaacactgacttaaaatccacggaataaattcaaactgtgcaatattttccacatctggcttaatcgcggcataaacagcatttccgacaaaattcagtcctgccattgccactcctttttcattcatagcatcataatacaaaggataatcctctgcaacatgagacattccaataattgcataatgatttttcatatcgccaacatggcgaaaattaaacgcataattacgtggtgtaattactatctgatcaccataagagaattcataatcgagggttcgtccaaagtaaaaatcttttgttttataagttgccgctgtacacatgatcgtttatcctcctaaatagattgaaatatgttaatgagtttttttcttgaacaatagtatagcacaatcttttattctgttccaacttcatacatgatcataacatgtaaactttaaactattttcctagattatttctccatcagtttttcaaaccaggtatccatagctaggatgaattgatctatgtctggcaattcttgcagcatttcgtttagggttttgtgcttcacatatttctgcattatgcctaacaggtatagatacctgatgcaaaaataatatttaattatcctcatctcttatttttgccaccatcaacactctccgattcgtattcaaggggacatcgtatatcttcttctaattttttcttatattttgccatataaaaatcaccttcaaactgttaatttactttcattatagcttgaagatgattatttttgaagttactattaaatttattagtaaacttctctattcttttctattttaatttccgataataataataaaacatcggtgctgtagtacaaatcgcaatcgtatctgcaattggttcagctaagaaaactcccattgctgaaccggataaaattcgcggtaaaataaaaatcaatggtatcagtaaaataattttacgccatattgtaagaaagattgcctttttcgcctgatccaatgcaacaaagctatactgacatgcgacttgtattccatatataagaagcattgcaagataaatccgcatactttttcctgtataagtaatcagaggcacatcgtccgtaaaaatagaagctacattttgcggtatcagcatacaaacaagccaaataagaaatgagccacttaaacagcatatgagtaataatcggaatgttttctttacccttgagatattttttgctccaagattataactcagcaatggctgtgctccctgtaccagacctggcaaaagcaacataacaaactgcatgctgctcgttaaaatactcatagatgccaccgctatatctccaccatacttttgcagagatgtattaaagctaattgccaccatattttctgtaagctgcatcaatgccggtgaagtaccaagtaaaatacatggcaaaagaagttttctttcaaaacgaatattttttaatcggagctttaattgacttgtcggttttataagataatgtataacaaaacaggttgatactccctgggctataactgttgccagggctgcaccttttactcccattccaaaaccattaatcagtatggcatcaagtacgatatttgttacagctcccactgccacgttacacatactgatcaaagtttttccctgtgcggtaataaacgcattcagtcccaatgtaagctgtataaatagtgtgccaacacagtaaatattcatataatccgttgcgtaaagaatcgtattatcacttgcaccaaatagttgtaaaatcatttttcatccttcatgtatccccctccactatatactatgcttaacaatttatgaaccattaaatttctttcttattatccgctcccggtgttgtaacaatgaccttagatggagtaatgatcagtgctcctttggctgttgctgcccctttaaacattccttcaacggcagtcttgaatgcagctacaatagctccttctgttacatattcagcagttcccttaatctgatatccttcaagactttttgtatcatatgcggaaattgcaattttcccttcattcgcttttatattctttaacgttgtctcaaggaaaacatctcctactaccagctttccatcttctgtaatatctttaaaagcaaccggtactacattcggttctccatctgcacatgttgcaagatcccacatagcattttttaatactttaattactgattcgtttaacattgaatatccattccttgtaaaaataaataataaaaagcaaactaattatagcgtatttattgaaaatacacaaaggaattctggtatttaaagttttgaatctttttctctttcacactcttcctgttgtattttctctatttccacaagaagatagcttgcagatttgaggacaaacagaaaagcgaaggtccctatagccctatctgtggcctgggagcacaaatatggcttatgaagttcactggcttctgtactgtggctggaaggtgatatttttcgtcaaatctgtctgatatatattttaagaaaataagaccgagtacgacatttttatattctgatgcatccatgtttccacgtaaaacacaggcagcatcccatatctgtctttcaaagcctatttcagccgtgtttttctttgccattacatcttcctccattgttaatctatgtaacaattttatcattcaaatctatttttttcaattttaaaatggtagtggctcttatttcttcttcctggcaatcaatactctccgatactgccgcattttttctgcacctaccagtgtaaagtatcgttttacatcctgatcagtcagaccttcttcaatgccttttataatctcttcctgttcttctggtgatagctcactggaatatcgtctaaagcaatcaataatgtctcctgataagtcccattgttctctatcctgtagcatatctggctgctggtctgtctctttttcttcttcctcttcgtttacctctgcaacttgtatttcttttaccatcttttccagttctctcaggcttggctgtggagtttcattgaagttaaggtaaaggaaggcttcttcgtcgtctatctggaacgtctgaatactggaatcttcttttgctttttcttcaaaaaatgtaaactcttcttttgaaatgtaattcaatcttgactcaaaacgggttgtgatatattttttatttctttcatcataggaaacatatactggatttttatagccattttgtccggctatcttctctgcttctttaaatacctctgtattaaacggccagtttttcttatcgtagatgggacgttctccctttaggaacagaatgcagtcgtttttcggcatccggctgatctgtcccggagtcattaatttcattccagccttgctcatctgcagattaccactgccttgtgaatgtcccaggctttcagaacggctgtcgatcgtcatgtcctctaacatatccgatacccattgatgtgttgtatgggctgttgctccagaacccaagaatactgttgtcgcacagtttcctgtgaatatctcccatttgtcattagcatatcctgctgtaactgcgttgtcccttcttcatctgttttttatgtctccttgtttaccagatcaaggattcccagcatagaagctgtcattccatcttcttttgcctgaagccattcatattcaaatagggattgcagatacagaccaacaccatcatcccagaaaggatcacctttttgggcatccggcggctttacagatgtctggatatttgtaatgagttctaccatatctgtataattttctatatatctgaacggattatactgatctgattgtgccatatctttaaaattaaggctttttacagctatccctttttcttttaaataacctccataatttttcagcaagtctcctttcacgtcaaggataatatttgtcatattcgctagtaagatattcggaatcaaaagggatgttgtttttccatcgccagaaccgccaagaatcaggatatgcatatttggcaatgactttgcatttactgtaatatttttactcaggcaggtaacaggttcttctccttttccatacagccttttagctgtctttgctacatctgcccattctgcaacaccatgttctgcatcgggatgaaaattacggtaataagtgagataataacagacaaacattgcccatgcagtcagggcaatccctataacggctggtgttttttcattgaaccagttacggaatggatgcatcaatatgtaggctaatttatcttgataattctgtatcgtcacatcatctagtttgaacaatcctgctatataataggatgcagccaatgacagaagcaacaggataaaaaacatcccccatggtggttttcgtttttgtatcatacatattctcctcatataataaaatgggcagaagaacgattttcttctgcccatattgtaaataagaaaacagctatgattttttatacaagtagctttttcttcttataaattatttatgattacatgtttatattattagaaagtgaataatgttattctcaactattcttaaaactcctaattcattcttatattttcatgccctgtattgcattttcatataaaaattgttttagtttctctgctgcaccagtattataataatttaataacaagaaattgaattgttccatgtatttatctgtaatcgtcataatagtttctttcacactccgctaaatccatgtactcggctcattttttctatattttaacggagacactccgtatgtttttttgaagcttctgataaaataacttacattctgatagccactgagcattgcaacctctgtaactggaatgtccgaattttgtaacaactgttttgcatgctccaaccgcaaatatgtgacatattttgaaagcgtaatatgaaaatgttctttaaaatattgcgatacatatttttcagaaagatggaactgttccccaagttcctttaatgatatctcccctgtaaaactctgctgtatgtatgaaatcatctctttttctacagtatttcttccacttttatcattttcgattataaatctattctcccacatgtgaagaataaattgtaaaagaattatttttgtctttatctgaacagctatttccaacttcttttcatcattttttgccatatatatttcggccaactgctcacacaactcttttgctgcatccttgatccttggtcttatcatcaaatgaccattttttaatggagtaagcaatttatcatctaacatgtcatctgtgcaaaaagagatatattcaagtggaaaaaggaaagtaaaataatccacttctccagcctgtgaacccatgaaatgcagattgcccggcgacactacaaaagcatccccgggggttccaatataattttctcctgatatacttacagtcaaaaacccactttttacatatataatttccagttcatcatgccaatgtaccggtatctgaaatgatcgtccctcattttttatatgatatgtactaaacggatcatcctttgtaccatgcggtttattttcctttaattcaaagtacataatctctcctatacttctataagacctttacttttccattttccactcttccatctaagtaccattcccacagctctcgcacattcgtcacctgccatagcaatatatgatcctacagccagaagtcccatgtgtattccgagaaaataagttccgccaactgcaaacaaatacataaatattgcacctagtataaccgggaaaagtgcgtctccactcgtttttaatgcctgaccatatacaaggtttgttacccttccaaattcaagaaagacatctactattaacaactttaccacaagatttatcatctgtgtatcatcagtaaatatatgcacgataaaatgtcctgtcaatgcaaatgtcacggaaaaacaggtcgctgtgatgataccgtatatcgcagcttttctcgttcccctgttacattcctcaaactcttttgctccaattctccaaccggtcataattgcatttgcctaagcaagggcagctcccacacaatatgagaaatttgcaatctgtacagcatatgagcgtgctgtaacattcattccatccacatccatctgattcataaaacgcacaataaaggtcattgcgatgttgtaaagtgctgtttcaagcgcagaaggaaaaccaatcttaacaatctgcgcaaatatctttcttgatgcaattcgctcaggactctgttttgcttttataagcacagcccccatacctgctacaataataagatttacaactcttgaaataaccgtggcaacagcaactcccattacaccccagttgaatacaaataagaatactgaattaagtattatattgagaacatttccaacaacagttcctatcaaagaatgttttgtatatccaaacactctcaaataactggagaaaataggaatcagtgcatttaaaaaacatgcgccgccaacaattctaagatatatttcagccggctcaagcaaagccggagcaatacttacgattcgaagtatcccaccagaaaaagtagcaagaatgacagacattacgatacctatcaatgcgttgaatataagtccaagttgtcttgcctgatacgctatccccggtcttccggctccgatattttgtgacataacagctatcatacccgacgatattacgccgaacatgataataaaaacacctatatatgtatttgctgttcccactgctcctacagcctggtcgcttacagatgatagcataagcgtatcgaccatacctgaaagcatataaaataaagtttctaagcatattggcacagataactgtgttaatgtttttctttcagctgccatagttttctcctcacatacaattcaagaatactatatcaataatacgatatatttctatgtaattcttgtataatatcctgtgaaaattgcactatttctactttatcttaaaaagtactagatcgtgttactgaaaaatggactccaaaatacccgaattctatgaaacgctggaaagataactgggatgcgatctctccgattttcaagttttcagcaaccgtcagaaaggtcatctatacgaccaatgccattgaatcgctgaattccacctaccggaaactcaatcgtcaaagaagcgtatttccgagtgatacagcactactgaaagccctgtatctggcaacctttgaagcaaccaaaaagtggactatgagcattcggaactggggacaggtctacggtgaactcagcattatgtatgagggacgactcccagaataacagaatctgtatgcatgatgaaaaggacgtttttgacgtccgctcttggcatgtctgaaatcatgtcgtatatataaaacaagagctggaagctccaatttagcgcttccagctcaatcattatcatagaagattattatttacagacttttcttcatagtctctaataggtataatagattttcctttttctgttaatgagtattctactcttggcggaatttcgtcatatgattttctttctgcaattccatcttcgaccagatcttttaaagttgctactaatactgcatccgtaatattatacatttctttacgaagctgactataacgtaatttttcattgaccgccagtacacatataattctcgacttccatttgcctccaaatatcgccagtccgtattcaaggggacatcgtatttcttttcccgccttttctctgatttacatccccaaataagggggtgacaacaaagcggaacccaaatgttagctggaaattgatctttttgaatggaattttgtgtcacgaacgtgatttgaaaataacaaaagcgttcgctgtcagctaatccagctaacattttcgaacgctttgaagcccgtcgccaagaggatttgaacctccgacccctcgcttaggagttcgcgtccgcacaggaaacctatataattttgagttaatacaagtcaaggaaagccttgattttactaactattctgtcatttcatgtcaaaataagaaaacccgaattcatcttagtaaatcatctttcggtgctcgtccgatgctcggagcaaccggaggatgtaactattgcgttccatcgagttcacttggttggccacgattacgattcggcatcgcaacaatactcacttggttttcttattagattaactatattataacgtgcatggggttggatgtcgatgattttttgaccatattttactcggatttacttactgctacttctagataaaaagattgaagcagttgctccgtacttccccattttactgattcagccatacatcatttttgctcatactattttccccatattatttttcaaactctggtttccagtttgcaaactgtacaagctgttcatccgtgcggtgataatatctttcattcttgtccagctttgcaatctgttccatttcttcatctgttaatgcaaaatcaaagatatccatattgtccttaatgtgttctgcatttttacttccaggaattacaacaaatcccatctgagtatgccaacggagaataacctgtgcaggtgtttttccatattttttgccaagtcctgcaaataccaactcattcattaatgctgtatctccatgtcccagcggataccagctcataagcttaattccatatttgtctaaagttacacgaagttctttctgtgtgaaatatggatgtgcttccacctgaataaactgaggtacaatttcccactttgtttccaactcttccatatattttccttcaaaattcgagataccaatggattttgctttgccctctctatacgctttttcaagcattctgtatccggcaagccagttgcctgcaggctggtgtatataaagtaaatccacataatcaacaccaagtctttctagagtttcttctacagtattctcattttcatattcactagcccatatttttgttgatagaaatatattttttctgtcaattccactatccttgattgctcttccaactgcacgctcatttacataagcatttgctgtatcaattagggaatatcccatttttaatgcctctaatgtacttgtgtaggcatcctctggtgataacataaaagttcctagtccaagcattggacattccaaattgttattcaacttcatattttccatctttttagtcctcctgaaatttttctttatcaagcatttttattacttttgccggatttccaactgctactgcataatccggtacatcctttgtcactacagatccagctcccacaattgcgtgtcttccgatacatactcccggaagtatcgtagctccagctcctacccaggcatattctcttatcagaacaggcttacaagtcagagtacacaaatcatatggatcatgattattggaaataagctgtacatttgcagcaatcatagcattatcttcaattgttattccacctcttgccattgcaagaagattacaattgataaatacattcctgccaatctttacgcttccaacacatgctccattaagcggtggtgatatcatactcccatctcctaggttatttccaaacaattcctttaataaatgattatattcatcagtaaaaggcattgtatgattaatctgaaataatatttttgtctgacgttgcccttctgtactttcttttattgacgcagttcttacatcaacacgtatttccttgcattccatttttctaacctctatttctgtatccatctttcaagtacatctttcgcttgatctacgttgcttccatgtatcgcaatgcctttctcaatcactgcaccttttgcactttttttaatatcactctccgtatttgacaatccgcttccttcatgcgtacagaatggatgaattttctttcctgtaaaatcataactttccagaaaagtatacacagccattggcatggttccccagtaattcgggtatccaagataaatctcgtcatattgatctatgtcctgtggcagatttagtatctctggtcgttttcctgtctgtttatcctcttttgcctgtgcaatgcaggtattataatcagcggcatagggaatcttttgctcgattttgaaaaggtctgctcctgtcatatcagctatcatttttgcagctttctcagtattgccaatctgaatatatttcatggaaccgccaaaataattttcatctgctctttttgcttctgaagaatatccatctgctcattcaacaactcaagtctcgcaggtattgtagaatctcccgccctaaatagcctttgatattcaatcagactttctatgggaagtcctgcatttctcatacatactgcaagctcaacccatctaagatcttcttcctggtaatcccgaattcctccggatgttcttgtaactttaggaatcacattaaccctctcataataacggagggtatcctgtgaaataccatatttttctgacacttcttttattgtcatattcttcctccacaatttaaagaagatttttcacactctgtatccattcattaatttgttcctgaggtgtctccagattacttccacctgtagaatcaaactgtatctgcatatcgcaaaccacatttgcgcctttgcaggctgctttcatatcctttattacatgccctggccagccaccatttgtcataaaaggtactattgtctttccggtaaaatcctgttggtgcagaaatgtttttacagccggagccattgtgtaccaccatgtaggtgtcccaactgcgatgacatcataatctgcaatattgatatccagcggtttaatttcaggttcgtatccgcgctgcacttcattctgtccctgatttaccacatcatcataactgccagaatatggaactacggtatctatttttagaatatcgctatcagtctcactctgcagcatttttgcaattctttccgtgtttccatttgaccatgaataatatataatcagtaatttcttcatctttttacctcctgtttcgattagtatactacttgaagttgactccaagtcaagagcttttgattttttcttcataaacgctggtatgacgcagactgtggaagacccaagactcgctactggcggttggttagaccttaccagacaggcattccacctgctagactactcgcccttatctgggcgcacaattccgatttgacggtaatttctgtttctctacatcctacaagcccagataaaactaatatacacagactaaataacagtactcttttcaaactcataatttctttccaagttcatatgcttttttcatcacatcaacatggcttgcagctatatttgcaacatcaattccaccgccaccgaccatacctttcaaggaagccttttcaaaacagtctacccagccttgcagaccattgtaggctttttcaaatgcactttcatcattctcagcggcagttgcaatcatataaatatctctgaatgaataatctgtcgaatataaaggattcaatctatcaagaagtgttttcatctggccacacatctcatagtaataaattggtgttgtatagacaatgacctccgcatcctttacttttgccataatatctgcaacatcatccttcagtacacacatcccattcctctgacaggatagacaaccgatacaatattttatatcttttcctttcaaagaaagaagttccacatcatacccggcttcttttgctccctttgcacactcatttgcaagtatatcagaattgctgcctcctcgaagacttgtcgatatgatcaatactttttttgccatgattaaatttctcctttttcagtgtcttttttaaccttccgtataactttcgcaggtactcctgccgcaatcatattggccggaacatcttttgttacaactgctccggctgcaatgaccgaaccttcaccaatcgtaacccccggaagaaccgttacatttgctccaagccacacttttttttcgatgtgaatcggctgaaatatcatacctgctcttttctcgggatcttccatatgattgatcgttgccaatactgcattatgtccaatcaggactccatcctctatataaataccaccctgatcctgaaacttacatcctgcattaataaaaacatttttacctatatggatatttcgtccgcagtctg

SEQ ID NO: 463 - DNA, 14008 bp, Eubacterium hallii
tgtttatttaggttttgaactttcgttctgttccatggactttcctgcagacatcactctcaggaaaacccgaatgaaatttgaattaacgttcaaggttgttttgttattcagttatcaaggttttatgttgttctttttttgtgacacaacttctttattttatcatacttagaagtctttgtcaagaacttttttaatttattttttaatgttttgttgcttttcttgagcaactcgtacattttatcatattcccattcatctgtcaagcacttttttatttttcttctttattttccaaataagagtgaaaaatattacggagaaggagggatttgaaccctcgcaccgcgcgaacgatctacacccttagcaggggcgcctcttcagccacttgagtacttctccataatgcctaaataaatgaaaatattcaattccgttgcacagtaatgcacaacgctttattatattatcaaaaagactgactaaagtcaagtctttttttaattattttttccatttttcttttgcagtctcataaaggttatttccatctttatctataactacaataacaggcagattctcgatttctaatttacggattgcctctgtgccaagatcatcgtaagcaactacatctgcttttttaatacatttagaaagtaatgcacctgctccacctaccgctgcaaagtatactgcaccatttctcttcatagcctctataacttccggagaacgctttccttttcctaccatgccctttaatcccttatcaagcatttctggagtatacttatccatacgactgcttgtagtcggacctgcagaaccgataatctgtccttctcttgccggacttggtccaagataatacaaaacattcccattgagctctattggtaatgcttcccctttatgcatactttcatacattcttttatgcgctgcatctctggcagtataaataattccggacagatatacatagtcccctgcttttaaagtattgatatcttcttcagaaagtggaacctgaattgttctattcataactgtatacctccccttataaacttcttactgcgtgacgatttacatgacagcacatattaacagcaacaggcagacctgcaatatgtgtaggatacgtattaatatttacagctaatgccgtaacagttcctccaagtcccgctgcaccaattccaagagcattgactcttttaaggacatcctcttccattgcttttatagaaggaagatcagaatgtgttcctacaggtcttgtcaatgcctgtttcgccatgagagctgctttttcaaaggtaccgccaataccaacaccaactacaacaggggggcatgcattaggccctgcatcctgtacggcagatacaatagcattcactgcgccttccataccatctgccggcttaagcataaatactctgctcatattttcgcttccaaatcccttcggtgctacggtaagcttaatattttctcctggaacgatactgtaatgaataaccgcaggtgtattatcttttgtattttctctgataaaaggatcatttactactgatttacgcagatatccttctacatatccgtcatgtacgcctttattgatagcatctgcgagagaacctccctcaatatgtacatcctgtcctacttccgcaaaaacgacagccattccagtatcctgacagattggtatctgttcttctcccgcaatagcaagattctctttcaactgattaagaatctggcagccaagaggattctcctcttggtctgccgctttatacaaagcattcttcatatcatcggaaagatagtaattagcttctatacacatttcttttatgtttctggaaatttcgtctacatgaattgaacgcatctttttacctcttatattcaatgacataacaactgtgaaaagcattcttattgattcattaagaaagcttctttatacttcttcctctgtggattgagactctgcttcatcctcttctacttctgcaaaatcctcttcctcttcaaatctgacttttgcaacgctggcaactttaatactgctttttgaatcaatattaataagttttacaccggaggtatttctgccaataacagaaatcgaatcactcttcatccgaatcacaataccttctgtagtaatcagcataatttcttcttccggcttaattgtcttcactccgacaacatatcctgtcttatcggtgatcttataacatcttaaaccttttccaccacgatgctgtacggtaaattcatcaagaggtgttcgtttacccatacctttttcagatacgatcaataaatcatcaccttcagaacgaatctgcattccaacaacttcatctgtatcaccaagattcattccgatcacacccatagaaactcttccggtttctcgtacatcctggagtttaaatcggatacactgtccttcttttgatacaaggaaaatatcctcattctcatctgtctgctttacttcaatcagttcatcgccctctcgcagggagattgctgccagaccgttctttcgaatattcttatactcatcaaatcctgttttctttacaagaccgtttcttgtagccataacgaggtaatgctgtttaccgtcttctaataacgggatgatcgctgtaatcttttcttccggctgaagctgaagaagattgataatattcactcctcttgccgttcttcctgattccggaatctcgtatcctttgagacgatatacacgacctttattggtaaagaacataatataattatgggtacttgtcataaataaatcttctatatgatcttcatcaatgacattcataccacgtattcccttaccaccacgattctgactgtggaagttatccggtgtcatacgcttaatatatcccagtttggagaaagtaataatcgcatcttttcttggaatcaatgcctcatcacttaaatcttccatatccatctcgatggatgttcttctgtcatcaccatatttatcacgaataagaagtatttcttctcggattactcctaaaagaaccttttcatctgcaagaatcgcttctaattccgcaatctttttctcaagttcatcatattcgttctgaagcttttctctctctaaacctgtcaatgcacgaagacgcatatctacgattgcctgtgcctgtgcctgtgagaattcaaaacgtctcatcagattatctcttgcttcagaaacattcttagaggcacgtatgatttctatcacttcgtcaatatggtctaatgcttttaaaagaccttctaaaatatgtgctctttctttggctttattcagctcatatctcgttcttcttgtgacaacatccttctgatgatccagataatgtacaagcatttcttttaagttaagaacctttggctgattatctacaagcgcaagcatgatgactccaaaagtatcctgaagctgtgtatgtttaaataactgctttaataatacattggcattcacatctttacgtgtctcaatacagatacgcataccgcttctatcagattcatctcgtaattctgtgattccatctactctcttttcttttactaaatcagcaatcttttcaattaaacgtgccttatttaccatatatggaagctcggatacgataattcgctgctttccattcttcattggctcaatgtttgtcaccgcacgtaccttaatcttgcctcttcccgtacggtaggcctggtcaataccctttcgtccaagaatagctgcccctgtcgggaagtccggtccttttacgatttctaaaagctcatcaatatccgtctctctgtcttcctgtacctgattatcaataatctttacgacaccgtcgatcgtttctcttaagttatgtggcgggatatttgttgccatacctacggcaattccctgtgctccatttacaagaagatttggaaaccttgatggaagaatacttggttctttttctgtctcatcaaagttcggtacaaaatcaaccgtatctttgtaaatgtccgctgtcatttccatggaaatcttagataatcttgcctctgtataacgcatggcagctgcgccatcaccgtccacagaaccaaagtttccatgaccatccactagtggataacgagtagaccagtcctgtgcaagattaactaatgcaccataaatagaactgtcaccatgagggtgatatttacccattgtatcaccgacgatacgagcacactttctgtgaggcttatccggtccgttattcaactcaatcatagaataaagaattcttctttgcaccggctttaaaccatctcgtacatctggaagagctctggatacaattacactcatagcataatctatataagatttttccatggtattctttaaatccacctcatggattttatcaaaaatattactatcgtccattctatcctcctgttagatatccagattctgtacatactttgcattggcttcaataaattctctacgtggttctacacgatctcccatgagagtatcaaatgtcatatccaattcggaagctgcatcatcatccatatttacgcgtaataaaattctcttttccggatccatcgttgtctcccataactgagatgcatccatctcaccaagacctttatatcgctggatcttattgtttccgtctcgtccgatatccgtcagtattgtatttaactcttcatcactgtaggcataccacacctttttattcttctccactttatacagtggcggctgtgccagatatacatgcccttctttaataagttctggcataaaacgatataaaaatgtaagcaataatgttgcgatatgcgcaccgtctacatcggcatccgtcataataatgatcttattatatctaagctttgtaatatcaaagtcttcatgaattcctgttccaaatgctgtgatcatcgcacgtatctcattattcacaagaatcttgtcaagtcttgacttttctacattcaaaatctttccacgcaatggaagaatggcctgcgttgcacgacttcttgctgttttcgctgaaccacccgcagaatctccctctacgatatagatttcgcaattctttggatctttatctgaacagtctgccagcttacctggaaggctcattccatcaagcgcagactttcttctcgttaaatctcttgcctttcttgctgcttctcttgctctttgtgcaagcaccgctttctcacagatcatctttgcaacattcggattctgctctaagaaataagtaagctgctcacttactacactgtcaaccgcaccacgtgcttcactatttccaagcttctgctttgtctggccttcaaactgcggctcaggaatcttgatgctgacaatcgcaaccaagccctccctgatatcatcaccggtaagattctgctcattatcctttaataacttattctttcttgcataatcattaaatgtctttgtaagtgcacttctaaaaccggccagatgtgttccaccttccggcgttgtaatattatttacaaagctgtaaacaccttcgttataagaatcattatgctgtaaggcaacttctacgaatacatcgcccttctttccctcacagtaaatcacttcagaatagagcacttccttacttttattcagatattctacatattcgcggatgccgccttcataatggaacgtcatggaaacttcttcttctggtcttcggtctgtaagaacaatctttaaatcctttgttaaaaatgccatctcacgaagacgctgttttaacactgcaaaatcgaaaacagtctcttcgaaaatggtcggatccggaagaaaacgtacctctgtacctcttctatctgtatctcctactactttcaacggatacataacctttccacgttcatatctctgacggtaaatctttccttcatggaaaatatctacttcaagccatgtggacagcgcattaacaacagacgcacctactccatgtaatccgccggatactttgtatcctccaccaccaaactttcctcctgcatgaaggatggtaaacacaacttctactgctggaattccctttttcttgttaattcctacaggaataccacgaccattatctctgaccgtaatagaattatcttcattgatgtacacctctactgtattacaaaatccagctaatgcttcatcaactgcattatctacaatctcatataccagatgatggaggcccttggatgaagtactgccaatgtacataccaggccttttccgtactgcttcaagaccttctaaaatctgtatttgatccgcaccatattcctgccccgcagaaatctgttcttcactcataattcaacctcctgtcaaaacttaatcaaataattataccataaatattgccatttattcaacttcttaaaccaaaccctctgttttttcttcctgtacacgcccctctgtcacacgaaataccttgtccagtgagatacggctattaacaaaatcatccagtcctgtacatgagatcagtgtctgtatatcctgaatactttccaacagccatgactgccttccagcatctaattctgataatacatcatcaagaagtaagattggtttttctcctgttacctgctcgatcaatcggatctccgataattttaacgacagtgctgccgttctttgctgtccctgcgaaccaaacttacggatgtcgatccctccgaccttaaaaagaagatcgtccctgtgtggacctactgttgttgtaccggaggatatatctttattccttcttgaatataactgttctctaaattcctccgccgaaacatttttctcatactctactttcatctgctcttttccaccggtaagctgactatgaatttttgccatcatctcatcaagaaattgtacaaattcttctcttttttttatgagaaactgtcctgctgtcaaaagctgttcgtcccatccatccaatgtttcgattaatgcaggatagagattaatctgttttaaaagattattccgctcatttaaaatcttattataagcaatcaattgctgcagatatcccttgtcaatctggcttaattccatatcaagaaaccgccttcttccagccggaccttcttttatgattgataaatcttctggtgaaaaaaagacgatgtgcatcattccaagaagttctcctgaacgtcgtaccggcacaccatctaccgcaatccctttattcttatttttctttaaatgaacatctaagcgatgggataacgaatctttctgaaaaaaaagacgaatatgtgcctcgtcctctccaaaacgaatcaattctttatctctgcttcccctatgagatctggaagttccacttacataaatagattctaaaagattcgtcttcccctgtgcattatctccaaaaaaaatatttactccaggagaaaactccactttaaccgaatcaaaatttctgtaattatttaattcaatcgattctacaaacatggagtcctcccatatatttattttactactcgtacttcgtcgccttcaaattcaaaaacatcaccgtcataaagctttctacctcttctggtttccacttcaccattaacggtcacctggccatcctgaatcagcatctttgcatcaattcctgatgatacgataccagcagccttcatagcctgtcccagtttaataaattcatctcttaattttaattccatattctttcttaaaattcctttctcattgtgtccgccattcgcgaacaagttcgttaaaatttatacattgctgttacttacattgattggtaagatcagatacagataagaagatgtctcatctcttataatacaaggggcaatagagttcatcaaatatattgtaacttcttcttcatcaattactcgaagagcatctaccaaaaactttggattaaatccaatcacaatatccttaccctctttactaattgaaatctgatctttcatagaaccaatctgtgaagagatcataagattcatttgttcattttcaattttaagaataatcggcttcttatctgattcttttacaaataaagtggagcggtcaagacaacgcaataattccattttattaattgtcaactttgtttcgtaatcattagaaagcatttgtccgatattataaaacttaccttctaataatcttgaaactacctttgtatcaccaaactcaaataaaatgtgcttatctgttaaatataaattcactgtatcttttgcttcaccaggaagaattttactaacttcagataaagttttacctggaacaataacttccatttttgaataagattcctgaagctcaatattacgaacagaaattctatgtccatcaagggaagttacggtcagtttattattttcaatacttaaaagttcacctgtcatcaatttattattttcattatccgatacggaaaaaattgtctgtctgataacttcttttaagtcaaactgagaaagagtaattttattttctttttcaatttctggtaagtgagagaaatcatctccctttcttcccatgatactgcattgaatctgttcacattcaatatttgtctttccggcttcatccgtttcgatataaacatcattatcaggaatctttttgatgatctctgaaaagatttttgcttcaagtgcaatcttaccaggttcaagaattgttccctgaattactgtttctatgccaagttctgtatcgttggcagttaatttaatgcagtcatcaaatgcttcaataaggatacattggagaatttccattgttgtcttattggacacagctttcgatacggtatttactccgtataaaaattgattcttagggcatgttatcttcataaatgtgtataactcctttcggtgtgaaatatatataaatataataagttatccgcagtagtagtagtagggggtgttagggatgtgaataagtggtaagaggccgataatacaaggattttcgaaaaggataactatgaggataagtgtgtgaataaaaaaatagttatccacatagaaaaaagtccgcaaaagttatccacatccatccacaggcaattcacatcgaatctgaatagaatgtggaaaaaaataaaggatagtctccagcgttgtgaagacacctttattttctgtttcttctatataaatgcctacgttggcgggttcaattttttaatgataatatcaaggttgctttttaatgtttcgtcggtttcgagcatcttattaattttatcgtgtccatggataactgtagtatggtcacgatttcccataatctttccgatattctggagagaataatcggtatattttcgggaaagatacatacatatctgacgaggattcgcaatttccttatttttcttcttggatatgatgtcagatacagaaatattgtaatgttctgcgacaacgtccataattagctgcggtgttacttctttttgacattcgatggtgtcttttaaagcgttctcagctaattctaaggtaacaggcttcttttcaagatttgcaaaaacaaaaattttatttaaagcgccctccaattcacgaatattggaattgatgttcgtagcgacatactgcataacttccggatcaatatcaagacgttctaattcggcacgcttttttaagatggccatctttgtctcataatcaggtggctgaatatctgcggtgattccccattcaaaacgagatcgcagacgttcttctaaagtagcaatctctcttggatgtttatcggaagaaatgacaatctgtttcttcgcttcgtgaagctcgttgaatgtatggaaaaattcttcctgagtactttcttttcctattataaactgtatatcatcgatcaacaggacatcaatattacgatatttgtcgcgaaattccttatttttatcatgttttaaggaatcgatcagctcatttgtaaacttttcggaagtgacgtataaaacacgcagatccggacgattattaataatatgatgagcgatagaatgcatcaaatgtgtttttccaagaccggctcctccatataaaaagaggggattgtatgctccgccgggtgattcggctacagcaacggaaacggcatgggccatcttattggtaggacctacgacaaaggtatcaaaagtatatcttggatttaaattaccaatatattctgcaggaacagtaacttttgctggttcaggctgcgatgctgcagaattggagtcggtaaaaagaattttaaattgctttccagtaacctgttctattgccatagaaaggtaaatgtcatagtatttatgctttataaattcgataccacgtggtcctcgtaccataaaaaaagtgatactgtcatccgaaattgtctgaatagttagtggttgtatccaagtattcacagcaacttcggaaatttcatgctcttttacgagaatatttagaatttcttgccattttgactcaattaattccttcattgttaactccattctggtttaatatgttgaactgtctgaacaaaaaataagcagagttcgagacggctcggcttttagtataagtgtataacagaacccacattttttcaatatacgaatgttgaaaaaatgtggataacttattgtggataactgagaaaaatgctgtttttttaaagaaaaaaaagaaaagtaacaaaatgtggataactaaaacgaatttatacacatcgaaaattgcaagagaaaaaaagcttttgacgaattttcgggatagatattgtgaatatttttaaagttatgcacaagttatgcacaaaatgtggataactcgtgcataacttctgattttgatgtgcaaaaaattaaaaatccggatttaataagaaaatacgcaggaattgcttgacttagaggacgtttttcaatataataggagtgatgtttttcaacaagacaggtataatattcgttaaggaggtggctttcgcatgaagatgacatttcagccaaagaaaagacagagatctaaagttcatggatttagaaaaagaatgagtactgctaacggcagaaaagtattagctagaagaagagcaaaaggaagaaataaattatcagcttaggtcgcagtgatgtggccttttcttttctcatttgattgtttggaaagttgagaaagttaagtgaatgaatttaagtctttaagaaagaattgggaattccaggcggtatatcgtaacggtaagtctaaggcgaatcgttgtttcgtaatgataataaagaagaatgacgcatcttctaaccgtataggaatttctgtaagtaaaaaagtaggaaacagtattgtccgccacagagtaaccagagtaatcagagaggttatgcgtcttcactggaaagagattaagagtggctatgacattgtaatcgtggcacgcccgtcagcgaaagagtctgactatgggaagtttgaaagtgccatttttcatttgttgaatttacatcatttattattagaagacgatgatttggaatgaaaattatttttattaaaataataagattttatcagaaatatctgtcggctcttaaaggaagagcgacctgtatatatacaccgacctgttcgcagtatgcgattgaggcgattgagaagtatggtgtattaaaggggggattgttagcagcgtggcggatcctgcgttgtaatcctttttcgaaaggcggatatgatccggttccatagttaaggaggaaaagtatgttattgacgcagtctaccactccgattatcggatggattgctaccttacttgggtatgtcatggaattcattttttattgtttgaatttcattggcattcagaacattggattatgtattatcatatttaccattattgttcgattattaatgctgccgttaacaattaagcagcagaagtttgctaagatcagtcaggtaatgcagcctgagatcaataagattcagagaaagtaccgtaataaaacggatcaggcttctatgatgaagcagaatgaagagattcagaaggtttacgaaaaatatggcacgaatccaactggtggatgtctccagttagtaattcagatgcctattttcctggcgttatatcaggttatccgaaagattcctgcatatattcctcaggtaaaagctgtttacatgcaggttgtaactgcaattgccggacaggcaggtgcaattgatacgattaataagattggtaagggattaaagtcttcttacgttacaacacttgcatcagatgcgacaaagaatcagattatcgatacactgaattattttaatgcggatgcatggcatcagcttgccaaagcgattccatctgcatcagatgtaattaacagttcatctactcatattattggaatgaacgacttctttgcaggaattaatgtttctcaggtaccgggatttcatccgtctatttattggctgattccgatactggctgcattattccagtacttatcagcaaagacaatgaaacagcctgagctggatgggaataatccggcagcaggaatgacaaagagtatgacggtcatgatgcctcttatgtctttatatttctgtttagttacacctgcaggtcttggtctttattgggtaacaagtgcattattccagtgcttacagcaggttattattaataaatacatggatagtgtagatattaatattctcgttgctaagaataaagaaaaggctgcaaagaagaaagcaaaaggacagaaaacatttatggagaaactcatggatacctctgcaaaggcagattctgctaaagagggagttgagaattcttacgaaagaaaaacaattaagcagattgcttccattaatacaaagaagatcgctggtccggagggaacagggaaagaagacttcgatagtcttagttctgtagatatcagtaagcttggagatattggtaaaaaagcatatatggtatctcagtatgagaaggaacacggaaataccaggggaggtaagaagtagtggaagttagagaatttaaagctaagacagtagacgaagcgattacagcggctacacttgagcttggcattagcagtgatcagctggagtataaagtaatagacgaaggaagcaaggggttccttggtatctttaacactaaaccggctgtgatttctgtgacagtaaagaagtctttattagaaagaacacaggcattttgtgaagaattatttgatgccatgaaagtggaaactacagtaaatattgactttaaagaagaagataatgtaatgaatattgatttatccggttctgatatgggtatccttatcggaaagagaggacagacacttgatgcattacagtatttgatcagtctttatgtgaatcgtgagagcgatgcatatatccgcgttaagcttgatacagagaattatcgcgaaagaagaaaagttacacttgaaaagttagctaaaaaaatagcatatacggtaaagagaacgaaaaaacctgttgctttagagccaatgaatccttatgaaaggcgtgtgattcattctgcacttcagaatgacagatatgtctgcacgaagagtgaaggtgaggaaccgtatagaaaagttgttattatgttaaagagagacagataacataagtatgagattagggatgtttaaagattcttacgggaatttttaagcatcctatttttgaatttacagaatgattatttttgaagctcagacaacacagcagatggagagtgttatgggaatgataaatgaatttgatacgattgctgcgattg

SEQ ID NO: 464 - DNA, 13583 bp, Eubacterium hallii
acctccacaaaaccgtccatcgttttttcagacgggttgccggagtccgttgccgggttttcacgctcccagcccttttgtctgccatattcggaaaacattcttgggtttgggaagtaccgccagccggaaatgcactggttcataatctcgttgatttcccggatttcccattgcttcggctcgtcaaaggcatggtttaaggcttccttgtaaagctgcttggagcagaccatgctcccggtgtacttgtcaaggtatgcctgtatcatcccggctttggtgtcctccggcataaaatcccgctggtgttctttgagatagcgctgcatggcagggctgaaagccagcttgaacctgacgcttttataaatctccatcgcttccgcccacatctgcccgatataggctctggaagcagcttcgtcctccaaaatgtgaacctcggcttgctccgggtacaccatgaccgggataaagcggcggttgccggaacggtcaaggggcaggaagtcaagggcattggaagtgccgccaaacacgcactgacggagacggtctgccgggtgggtttcatagggtatcttgtaaacctctttctgccggcttaaaaacgacttgatttcctcaatgctcttggcgttggcggttgccatcatttccgacatttcaataatccaatgaccttgcagcttgcggtacacattgtcatcgtccagcttccgcaaatcatcggagaaccactcatcccggactgccagcagacggaagaaagtggacttgccagccccctgaccgcctaccagacagagcatgatttcaaacttgcaccccggctgaaaggctcgtgagatagcgcccatcagaaacagcttcaacgcttcataggtgtaatcatctgcgtcagcccccagaaagtgccgcaggcagaagcggattcgttcctttccgtcccacacaagggaacttaaataatcccggatgggatgatacttgttttcattcgccacaattccgatggcgttatcaatctttttctcattggtaagcccgtaggtttcttccagatagagaagcagatacttcatgtccgtatcgtttaaggcggtgctttccctgtggaagccgatgggctttatgatgtccttgcggtcggtcaggatgttgtatgcgatagctccggaaagcagcggatcacgctggaatacggtcaggcagttccgtatgctctgacggacaccgcctttctcggtggtttccagccccgccttgatttcctcaacgctctggggcggctgcatggcgttcatggtgttttttagttcctgctgcgtctgtggcggcaagctctgccattcgctgttcaagctgtatcacatcctttccgtagtccgtaatcaaagccgctttttcctctgtttccccgaacagcagcacatccagctgatattccacatgggcttgcttctgtaaggcttccacaaaccggggatgaaaggcttcctccggggagtgtggggcgtagtccgttctccatgccataagcaagtggagataatcggcaagaatacggaagcagcggttctttgcttcctgaaactgttcctcctgggatttctgccggggcttgggctttttcgcctttcccggcggcttccaatcctcataggaaagcccgaagtcctgtgccagttgtatggcggcttctttctttcccagcccatacagggcggcggcaaaatcaatcacatccccatccgcaccgcagccgaagcagtggtaacgcctatccagcttcatgcttggggttttatcgttatggaacgggcagcaagccatcccgttccgacctacatggattccataatgctccgcagcctgtcttgttgtaacggactgcttcacaacttcaaatacattcaaatctatccctccttgaaaaaaagaaaagcacctgacattctctgattgaaaatggcaagtgcctgttaaagttccatatcctgttgtctgtgtttcgtctgtgcctgggctgttctttgtgcttttttctcgtctgccttatcctgcaagacttctttgatgggctgcttcttgggcggctctttgctttcctctgtgccgggtgtggctttccgtacccagtagcggatgtcccgcagcttcttcaaatcctcctgtacctcggtcagtggtactttcagctctgcgatttcgctgagaagcgtttcctgctcctgttgcaactcatttttcgttttatccttatcgtccgggtgcttggcaaggtagtcaacggctttctcataccgggcaacctccgggtgttcctgtttgaatttctcctttgttttcttaaaaaatatcttctggtacttctcatagacagccttacattccttgcagtctgtccggctggcaagaatcccgtcaatcactttgctccgggcttcctttggcttcatctgattgcggtaatctgcggctgatttcccggaagattccagaaacgcttctaagtcctccacagtggaaagccccttttgccggagataggacagggcttcgctgactgcctttaagtctttggaagtcccccggttctgcccagccctcgtccagtccttccgttcttcctttcgtatctccatatatttcatcagcagattgggaagaagtgtcgcttcctccgcctccttttgtgcaagcagttccttccgtttttctcccagctcggtaatccagcctttgaggttgtggatgagctgccggatggactgcattaaactgttggcggctttgatttcccggttcaggttgccgatattcgtctggattccacgcttttccatctgccggacagcagccccctcatggacagtggggactatatcaagcccctgtctggcataggaacgcaagtccacacgctccgggcggttattggcttccagatagcggttctggataacctcccattcatgccgccagatttcacaatacttctggtcgttccagtcaaccgtattctccttatggcttttccacctgccggacggcagctttatccgttccccgttttcatcaatgtcataaaccttgcggctcttgggaagccatttcccatgttcgtccattgcccgcatggtcagcaggacatgggcgtggggattgtgtcccggcgggtgggggtcatggatggcaaagtcaacaatcatccctttggaaacaaactgctgttcacaaaactcccggacaaggacagcatactggtcgggcggtatctctttggggatggtaagcacccaccgccttgcaagctgggagttccattgcttctccaccgcttcggcggcgttccatagggtattgcggtctgcatactccggtggggcatttgccggaaacaggatttcattgtggacgataccacgcttttccgagtagtgcttcacttgctggtcgtattcacagaacagcttttcgccgctttggtaagcagcggcggcaaccgcagactgcagttggcttcgctgcacaatagaaatttcgttgtgtggacagggcatttcgtgtccctcctttccttgatttatggatgggatggcgttttaccacctcattttgggcagaaaaaaagcaggcaacctttttcagatttcctgcttggtgtgccgctttgtgggcggcggatatttagttgtaaaagttcgggagcaagttgacccgatgtgtgagtggcaaacttgaagttgtcagtccttcttgttcttttcaatagcactaatggtgcaagcaaaacctgtaatcattgaaagtagtattgctccacccattgcttcgttcattccagcaccaaagaaaaaaccgaccaccgccgcaattaccataagaatgattgaaatcattactctcataatatatacctccataacttagaattttctactcttatcaataaccccaagtcatcagattccattctccaccttcactccgtgcaagccaccatgaccaagtgtattcttcgttagcctcccatgcaccgccaccttttttcggcgaacgaaaactgctttcaaatgcaatacattgcgtaaaggcttctttattatcatccgttcttaaatcgttcatccattcaatgttatctgcattgttgcattcttcatccggcatataagaaaggctatgcaattcacagccctcaaacgaagcgaactgcttttttataatctcaatggcagaatctatttcttcttttgaataaacggaagatgctccataatcaatttccacttttgatgtatcaccgttctttccgcatccggcaaagagaagaaccagcacaatgcaaagcgttacggttataatctttttcatagtgaatacctccaacttccgatttctcattaacttcattatactttattcgaccctcaaagtacagagagattttgtaaaacttgtcgcctgggaacagcttgcaacgcaaggtgtccccagacggcaagtccacaaaagggtagctggcggcagccagcgcaggggaagcgtagcgtctcctgtatgatttggagcagaccatgactgcggaaaatcacagccctccggcgaggagccttcggagaacgcaatgcaccgacctctgggtggtgtataattgcgcccttagtaaactaaggggtttccggcttctcccgttccagcagttttttcaatagttcctgcgtgtcctgcctgtgaaaaatgagtttcaacaacagcatgacatcatcatctgtcaggcgttccggctcttgcagaaaactttccagcataccgccacgggtacagagccggtgcgttcgttcctttcgggtaagctgctttaactggtactgcaatgccttttcatcattgatggctttccgcagtttcttttcgcttttctccagctcccagttgagtttttccagctttgaggtctcaggcaagggcagcgtcctcctttcccggtatcagcacataaatccggtttggttctcccacaccctgacgcacccgcatgataagcccagcggtttccagttcattcagagaacgcttgaccgtcatggagctgcgggacaggactgcggcaatggctgtgacagggaagcagacaaacaggattccgttttcgtcctcctgccctttggatagcatagcgtccagcatccggcagtacatgacctttgcggtgctgctgactggaaatcctgtcaacgctatgggaaatggcatacacggcggcaatggtgtgtctatcgtcataaattcaaaattcattcggtgtgttcctcctttttctttgctcgtttggataaataacgggggcagtcaaccacaaccgcccggaagctctgcctgcacccatgctggcatttccggcataattcgttgtaagtgacacgcccccggtcattgaggtaaaaggaaagctcatgcttcctctttttgctcattctcggcatattgcgtttcctcccgtttttgtgtatggtttcggggcgattttcggcaaaattacggtcatagagccgcttaaaatctcccgaagtatcagcgatagggtagactatccccctatcagattgtcgtgtttcggtatcatttcggtgtcagttcgccagttctccccggtgtcgttcctcccctgaatctcacagcggcgtatcgctccctttggtatgctcgttttggtcagggttcctccatatccctgccaaaagtcatggcactacatcaccggggaagcatatcccacacaggctggtcattcgattggaataatccatcgatgaactacctgtatcatagaacatttttgtgccctgtgccgtatgtccacaaagtaggaattcggggtaaaaatcagaaatttccacgattgcggaattgatatggtataatcaattcaacggttataaatgtcgttagaaagggggaactgcttcaatgaacggagctactacaatacaggaacggctaaaagatttacgattaaacaaaggattaaaactggaagaactggctgagcaaacgggtatttcaaaatcggctcttggcagttatgaaaaagatgactataaggaaatcaatcatggcaaccttatcctgctggcagatttttatggggtgtccctcgattatctcttttgccggacagagaaccgggcggagatcaacacgccattaagggagctgcatttgagtgatgagatggtagcacttctgaaaagcggtcggattaacaaccgtctgctgtgcgaacttgccacccataaggactttatcaagtttcttgcggatattgagatttatgtggatgggattgccaccatgcagattcagaacctcaacgcccttgtcgataccgtccggcatgaaatcattgaacggtatcgccctggcgaagacgacccccatttgaaagtgttgcaagccgcccatatcagtgatgatgaatatttcagccacatggttctgaatgacctcaatctcattatccgggatattcgggaagcccataaaaaggacagcgagagtgcaccccagaccaccgttgctaatgaactgaaagaaaatctggaagcggtcgaaaatttcaagggcagccgggatgaaaagctcgttgtactttactgcaagcagcttggtatcaactataaaaatctgtcagacgaagaatttcgctggctgattcggattctcaaaaaatcaaagaaaatgggaacgcctatcagtcagaggaaaaaacggtaaagaaaaaccgctgttgcatggtttgttagcttccatgtagcagcggtttttgctgggattattcagttgaatttttagaacgacactggaagttgtttatccaaaatgaaatggaataaccatatcaagtaaaactgcaagaactatactaattgttcccattagcacagaacttttcaatgtgtccctcctcaaaacagtaagtccgatgataaagactatcaattctaaaacagagcgtgcttcgaaatatccccatccatatacgaaagtcatgttaaacaatactgctaaaatcaatactgatagcataaatgcaggtctgctttttcctttcgcataccaacagacaaatgccaagaacggagaaatcatggtaaagccaaaccaaatcatagcgtagcttcttgggaaaaatcctgcgacatagtttgaatacaaatagtaacttgcaaccatgccagcaaaaaacgcaaaaacattaacacttgctcttgttgcagaattactataaatagaaatacacagtgcaatcaatacccaaatttcaaaacgcccaaggaaattatgaacatctaatgccccatctattgccataagcacacttggcagttcagtttgacgaaaatccaaaaattttgaaaaagtccccaaagctattccaaggaacaatacagctatggtatttataatttttctattaccagatataggattttccgcactccttatatcattcaaaaacttgttcataggcatctcccaattctaatttaacagtaatcattctatcataccgttatgaataaatcatctcatgcaaaacaatttcttctgcccggttgtgaatgttattgcaacgctgcacccattccatttgagaagtgcgctttaattcctctgtcacgccctcgacagctttcatctgctccatgatggtggctaaccgttcctgtgcttgttcgttcaggtctgcaaggtatgtccataactccccggtcagtgtcaatgtgttcaatctggctgggtgggcttctcttaaatattcccggtgtagccgtccatactttccaatggggcggtgttcctccggcagtttcaagtctgggatgtagtaatccccaacaaggatataatcaattccgttttccgttattcttgatttcaattcgctcatgttccttacctcctgtggaagcaggctcgtctggtactaactcaatcacatcggtaatctcacaattcagcgtttcgcagatacgggctaatgtatccatgcttatgtgctttccctctttgctcatgttagcaatcatattcgttgtcataccggcggcaagccttaaatcttcttttctcatatcacgctctaacagtgtatgccagagtggtttatagctgatgtgcatattgttttcctgcctttctatccataccaccggggcgactgccccggcaggaacttttctcttattatagcaccaatcttgtgaaatcacaatttattcttgtagactgccgctgataccgtctggattgtgcttttcctttctttttgttccctttaattagccatgaactgcttaattccctgggattttgcttatgtgtgataaagaagtaatagaagtgtaaaaaattttgcctttcctatccgatactcagctctggtatcggatagggcgggcggttattcgggcaagtccaccttgccaacaaaagaataataaatctcaatgtcctgcctacgggtcttgttctcgtcatagctgcactcatgcacaacgattttctctacaaactcccgcaacagagtaggggtaagttcttcaaagctggtatgccgccggacaacattcataaacttttctgcgttcacggtggcttcctgtgctttggaaagctccgcttggatagcagcggctctttctttcagctcccgttgttctgcttcatagtctgccgacagctctgtgaaacgctcgtctgatatgcgcccggtcacgctgtcctcatacagccgcttgaagatagcggataactcggctatgcgtttctcggtggcttccagctcctttttcttggcggcgttcctgcgcttgcccccgtcctcgttctgctcaatcaagagcttcataaaccgagcttcatgctttgccgcatagcttgtcactttccgcagattggagagtacgccagcggtcaagaggtcggtgcggataaagtgcgccgtacagtcatgggtgcgtttcttgtagttgccgcagatataacagtcctgcttgcgcttgtccgtctggtatcgctgctgatacatgacactgccgcagtccgcacagaacagtatgccggagaacaagcccacttcatcatagcggttggggcgtttgcgctgcttgcgaagttcctgcacccgttcccatgtctgggtgtctatgataggctcgtggtggttctcgaaaatcacttgcttttccgggggattttctacactgtgcttgactttgtaagaaagtttttctgtcttgaaatttaccagacagcctgtgtattcctggttttcaaggatatgcacaacggtattggtcgcccacttgcactcatagccggggtggtagcggcgggtgctgcccgtcctacggtattccagcgtccccggcgtgaggatttgctgctctgtgagcatacgggctatcttagtcggaccgttcccggcaaggcagaggttgtatatctgcttgactacgggtgcagcttcctcgtcaataatgaaattttcgtcctcgtccatgaggtagccatacacaggcttgcttgtgatgggcttgccactcatgccttttgagcgttttactgctttgattttcttgctcgtatctctcaccagccattcgttaaagatattccgcagcggggcaaagtcattgtcgccttgtgcgctgtccactccgtcattgatagcgataaagcggacacctttctgtgggaaaatcatttccgtgtacattcccacttgcaggtagtttcgccctaacctcgacatatcctttacgataactgtcccgacttttccggcttcaatgtccgcaagcatggcttgaaaaccgggtctttgaaagttcgcaccagaataaccgtcgtccgtgtaccagcgcagattggaaaagccgttctgctttgcataggtttcaaggatacgcttctgattggaaatggaattgctctcgccttgcagctcgtcctcatgggaaagtcttgggtaaagggcggtaattggttgttggttggtctgtcttaacataaaatcctccgtttccgacagccagccccactattccgtaccttgattgtaccacatggggcggctgtctgtatagcggcaaaagcgtcaaatctgcttctttatggtcggtcaaatcgctgttttttgtgtagcagcttccgcttccagcactttcatcatcttgtcggctgcggtgtcggttgcgccctgcttgaagaagccggaaacggtaaggacggagttgcccatgcggatttccgttacacagtccgggcggcggtctgttttggtggtgcttgtctgtttggtttctgtcataggctctcctttcgctgcttcatcagttgctttaagcgttccagcttttcctgtgcggtttcctttcggaagttgctgcccgtgaagcggacaggggcgcacatggaagtcagcctgtcatagatacgggcgtggggcgtgtcctgcggatgctgcaattcctccagcgtgaggttggtcgtggcgatcagcggcttgccgcttcggtaacggctgtcaatcacgctgtaaacctgttccagcccgtattctgtccctcgctccataccgaaatcatcaagtatcagcagagggtagctgcaaaggcgggaaatatattcgttcctgccctcaaagctggcggcaaggtcattgagtatcgttgcaaagtttgtcatgcgaacggcaacctctttttccataagggcgttggcgatacaggcggcaaggtagctttttcccgtccccacgccgccccaaaacaggtagccgatattttcagcctgcatggtttcccagctctccacataaaagcgggcggtttcggtctgcgggtttctgccgttgtcatgctcaaatgtccagttccgcatagcagggtcggtaaagccccggcgtttcaagtcctccactgtttcaaggtgcttctgtctgctttcggcggcttcccgtttttcacgggctgcccgctggcagtcgcactctgccgggtgtcggtcatgccctaaccattgggcggtttcttttggaaagtaggcttcttttggcgtatggcacttgccgcagtataaaagcccgtcctcgcctgtgtagtcctccgcttcggcggtagtggttgtaatgtccgtaatcatagcttcaatctcgtttttcataagctctcgccctccttgcatgagtaatcgggtatgccctgtttcggggcagccttgcctttggcagtgtcctcctgcgcccacttgtaaatggtggctacatggctgtggtactgcttcccggtggaagcgatatggcaggaaagccggtcaatataatactcccacttgtcgggcagctctgttttcagcccggaaagctctgtatcggtcagtatcacattgttgtatctgccataagcggcgggggtggggggtcccgtttctccctctctctctttttctatctctatctctttctctaactctatctctatctctggtggacgaatgtcggacaaatgtccgccttttgtccggggcggtaaaagtgccttgttttccagccttgcagcccgttttcgctcggcttcggtagaggactgtcctatcatcagctcaatgtcggtcatatagaaagccccgctgtcaagctgctccacaagccccaactgccggaaaatctctaaagccctctcaaccgtccctatctggtggcgggtcagtgtcgctatcatctgcgctgtgtaggggatatactcgtcaagctgcaacttcccgccgtttttcagcgattttaagtacagcttcaagaggatattggaatataaaatcccgtctttcatatcttccagcagcacaatggagtcgctgtcaaaaaagttctctttcagcttgaggtagtaatatttgcggttatctgccattggcggtgtcctccctgtgtttccatctcttagagaaataccgggggcagaggacgataatcgcccggaagctctgcttgcagccgtgtgtgcagccccggcaaaggtcattgtaggtaatacggtttcggtagttgaggaaaaagctccattccaaccgccgctttttgctcatgcgtggcatttctcgctcctttctgccgtttccgctggtataagcggataggtcggtaaaaatgtagtttctcggtgtcattttcggggatttcctgcgctgtgcgccctgttttgaggtcggggagtattgcggataggggtaagggcatatccctgtttttgtttggtttcggtatcatttcggggcggtttttaacgctcctgttcatgctttttctgtcggctcggctcgccgtggtgcatttgggaaagattgcttttcatggtctgcaattcccggacacgctctttatttgcccggtactcgttgtaaagggcgttcttctcggcggtaagctgctcgatttcagcctgcaacgatttataggtgggcagcttggtaatgcctttttgccgaaaatatcttacggctgcgtctgctatgataaagtcgctttcatgcttttcccggtaggctttgcgtgccttatcggttttctgctttttcaatccgtcacgcacatctcttgtcttggcataggcaagcacctgtttctgcaagtcctttttctcacggatagccgtttcaatgggcttcagcttggcggtgctgctgtgtaaatccgcattggcagacacaagggctgcgtccagttcatccggggtaaagccgtattgctccatagcggcaacggtagccgccatctgtttgagattatggacagccgcccaacggtcatagccgataccttttccctcggctcgcttcgccgcacggtcaaccattctctgaatgttgcctgccggggcgattttctgcgtttttcctcgctctgtgcggtttgtttcagcggtatggtattcgggtatgggtgcggtcttttcggcggctctgtgggcgttctgctccaaaagggcaagaacggcggcacggtcaaaatcatctcccagttttcgggcagtaatgggtttcgttctgtccggggtaaggtaggacaaccgccctcggctctctttgacgatcacaccctgccgcagaagtaaagcggaaaactcgtcaaaggtagtagcttcgctcatggcgttccgtatggtctgccgtagcttcgccttgtcggtttcaaacttggtctgctttacaggctgcccctcggctgcaagggtggcattttccttgtcaagtttggcttgtcctttcttctgcgcccaatactcacgctcggtaatgcggtttttactgccatggagcaggtcgatttgatagagattttcccggtggcacatctccatgacctcggctttgaagtattccatagcagtgtccgtgcagcgatgtttgcacccggcacgggtatctgccggtctgtccatgtagggcagcaagggtacttcctcaatacgcagagaattgataacgatatgaacatggatattgccgct

SEQ ID NO: 465 - DNA, 13425 bp, Eubacterium hallii
tgcatattattccaaaatgcttccatttgtggaagaacagctgttaaaaggaagaattaatgaacatctggcatatctgtatacttgttttcaaaaagaagttcttgaaaagccggataactggaagtcagtatgtgatattttattttatcataagctgatctgtaataatccgcatatcagtggcgtctatgtttcctgtccggaaacagaacaggaaagatactatccactttcggcgggggtaagcaatgtagaagtatataatagcagagctgtattttattttgtagataataatgagcagagatatgtcagagatattcaatatcagttaaagccgttcttatcaacagaacagtttgaaaaagaatggattcgccgtaacctttctaataagaagattttattaatggaatcagaaaagatgaacgagggaatcaaagaagatggcatagccgttcttcagcagcttacatttaacgatgattttgtacgttggattcagacagaggcagttgagaagctgcttacctattatgagaatcatcaggaaaagcgaagcctggccagatggcttggaaagattgattactcgaatatttctgtagaatttaggaagacattaatggattattatatggaagtcggcatgatggaggaggctttctttggaatcgaattatatggatgtgatataatgggttccgcaaagattctccgtctggcatcctttggtgcacaatattatcagggaaagaaggatgaggaaacactttccttagcgtatgcggcatttattcgaaagaagtgtaacaaagatacactgacgtatctgatgaagcattttcagggtgaaacagcagtgcttttggatatttgggaaagaggcaggcgctttggccttgaaacggctgattttgagcgaaaggttcttgaacaggtcatgtttactggtaatgatacagaaggtgtatttccggtatttgaatcgttctatcagactaatgagggagatgatctgattgaccgttatctggaatatgcatcgatgaaagaattagaaagttccatggagctgaatgattttatgcatatggcaattggtcaggagattgtaaatggccgcatggaaaaccgacattccagaattcatttcctgtattattttgccggaagagaagaatggtacgataccattaaagatacggcagtatacattatagaaggctttttgcaggaaaagttttatcttccgatttaccatgcgtatgcacagtgggttcattttccaatctattacagagaattgacattcctgacatatagaggacgtgcagggcagcatgttatattgaattatcagattgatggtgaacaatattctttccgtaatctgaatttggaagaagttcttccgggaatgtatgtctgtcatatgaatttcttccagagagatcatgtaaagtatcgtctagaagcagacggaaagctagttgcggatgagaatgccctggaatttgaaacatttgaatatgaagatggagaggaaagccgtttctttacattgaattatttagatacggaagaagcatcactgccagagttaaaagaatatcttttaaaaactttttttgcagaccagtgtatgaagcttttgtagataaaccagtgtatagtggttcagaaaaacagattgagaggtttataatataaatggaagaactggatacaaaaaaatatgcgggaattgatctggggaaaacttctgtacagtttagcatatacagggaaggacaagaagaaatgtccgaagaaagtttcccaatagcaaaagagcagcaagaggcatatatagagacaggaatccatctggtggaagagtatatgaaggaaaaagaatatcaatggtctgattatcaggcggttcatttttccatgcaagatccatccgaagaaaacagagataaattaaaagaaagtgtaagtgaagagtttttaaagtttcatacagtaaagatcatcacacatttcagagcatttgcagaatatgtattccatcaggaacgaattatgtgggatcgcaatacacttttattagattatcatgataaccagctgagttatgtattgatcgatcagatacgccgttcaagacagaaggcttaccgggcagtagaaaaacagattgatcttaatgaatatcgggtagtggaaggaacaccagaacaggatgcgaattttggacagatggtgaagcgttttcttgtaaagaccccggcaaatattattttccttacaggaagtggatttgaaggaaactggatgaagaaaacgctgacctatctttgtgccggaagaagagtatttctaggacaaaatctgtatgcgaacggagcctgtcttctgggaatccacccgatcgagcttatggatgagggaatgattctcatggatggaccggatatggtctaccatacggtgggagtgattacaacagaggcagggaagccgcagtatgtaccgataacatccataggaagagagtggtataatacgcatggcagtgtggatattattcttgataaaagccagcgggtagattttttctatcataatacgaaggaaaatgaaatcgagggagctgcctgtgatataaaaggattgccgaagcgtccgcctaaaacgacgaggatccgcatagaagttcggtttacttcttcggtggagggagtgattttactgaaagatatggggtttggagaaatgtttccggcaacaggaaagattacagtctttccatttaaattaatttcgtaattaagttaatttcgtaataaaagatcattacggagggaaagaggtaaggaagatgagagagtcacttatctgtattggtaagattggaaaaaaaggatattattttgaagataccggaatacagattttttcctatgaggaactttgttattatttaaaaagacatatgatctgctatatccatacacttcccggagaggatctgctcgtatatctcagggatgaactggggctggaaaagttatataagcagctgattcgtctgacagatccggaaaaggaccagatgaagtacttttctgcattatttcgagaagggcattattttaatgaagatgagataagagatattttagatgagtatcgaagccttatgaatgctccggtttaccggcagaaaaaatggatgggcgacctgcttgtaaggtcaggcagatcagcaagagcgctggaaagttatcaggaagctcttgtagaaaaagacttggaaaaaaatgagattgggcggatctatcataatattggaatcgcggaatcaaaactttttcgttttcagaatgcaaagattgcttttatcaaggcatatcagcatttaggcgaggagaaatctcttttttattattatgcgattacggcattgttagaaggaatcgaagcagcaggagaagaattgaaggaatttgaggattccgatatgttacttgatgcatttgaggaaaagtttgcagaatatcaggaagattttcaatataatgcggtatcggaaatctataaaaaaatagtatttttaaatgaaaatggaaaagaagaagaggctaaaataaagaaaaagcgtctggttcgaagcctgcagagagattttcgcaaagaaatagaaatttaaataaaaaatattagtgacaaatgcgcaaataagttatactatggtagctggtacgttatttacgatataacatcagagttagaatgtcaggagatttatagggacataccaataaggaatgcctggcatatatgataaaaactaggaggaaaccacaacatggcaacagaaatgaacaaaacctacaatccatcagagattgaggacagactttataaaaaatggatggataagaagtatttccatgcagaagtagatcgcagcaagaaaccatttacaattgtaatgccgccgccaaatattacagggcagctgcatatgggacatgcgttagataatacactgcaggatattctcattcgatttaagagaatgcagggatataatgctttatggcagccaggaacagaccatgcaagtatcgcaactgaggtaaaggttacaaacaaattaaaagaagaaggcattgataaagaagaacttggacgtgaaggattcttaaagcgtacctgggagtggaaagaagagtacggcggacgtattgtcagccagttaaagaagcttggttcttccgctgattgggacagagaacgttttacaatggatgaaggctgttctaaagcagtacaggaagtatttatccgcctttacgaaaagggatatatttatcagggctcaagaattatcaactggtgtccggtatgccagacatctatttctgatgctgaggtagaatatgaggatcaggcaggacatttctggcatattaactatccgatcgttggaacagataaatatatcgagattgcgactactcgtcctgagacaatgcttggagatactgcgatcgcagtacatccggatgatgagagatataaagatttagttggaaagatggtactccttccaatcgtaaataaggagattccgattgttgcggattcttatgtagataaagaatttggtacaggtgcagtaaagattacaccagcacatgatcctaacgactttgaagttggaaagcgtcacaacttagaagaaatcaatattttaaatgatgacggaacgattaacgaaaatggtggaaagttcgcaggaatggatcgttacgaggcaagaaaggctatcgtaaaagagttagaagaagaaggatatcttgtacgtattgaagcgcatgaacataacgtaggaactcatgaccgctgtcatactacagtggaaccaatggtgaaaaaacagtggttcgtaaagatgagcgagatggcaaagcctgcgatcgaagcagtaaagaacggagatcttcgttttgtaccgggtcattttgaccgtacgtatctgcactggttagagaatattcgtgactggtgtatttcaagacagttatggtggggacacagaattcctgcatattattgtgatgaatgtggggagattgttgtagcgaaagaaatgccatccgtatgtccaaagtgtggatgtactcattttacacaggatgaggatacattagatacatggtttagttctgctttatggccattttccacattaggctggccggaaaagacagaagatcttgattatttctatcctacgaatgttcttgtaacaggatacgatattattttcttctgggtaatccgtatggtattctcaggatatgaacagacaggtaaatgtccatttagtgacgtacttattcatggtctggttcgtgatgaacagggccgtaagatgagtaagtctcttggaaatggtatcgatccattagagatcattgaacagtatggtgccgatgcacttcgccttacattagtaacaggtaatgctccgggtaatgatatgcgttattcagagaagaagattattgcaagcagaaacttcgctaataaagtatggaatgcttccagatttatgttgatgaatattgaaaaagcggacttaagcaacgtatctcttgcagacctgacaccggctgataaatggattttatccaaagcgaattctctggtaaaagaagtgacagacaatatggaaaaatacgatttcggtgttgctgttgccaagttaaatgactttatctgggaagagttctgtgactggtatatcgagatggtaaaaccaagactctataatgaggaagatacgacgaaagcagcagcgctctttacattaaagaaagtattaacgatttctctgaagttgttacatccatatatgccatttatcacagaagaaatcttctgcagtcttcaggatgaagaagagtccattatggtttctgaatggcctgtttttgaagaagagtttgacttcaaggctgaagaaaatgaagtagagatgattaagaatgctgtaagaaatattcgtaatcttcgtgcagatatgaatgtaccaccgagcaagaaagcaagtgtctatgttgtatctgaaaaagaagaagttcgcagagtatttgaggattctaaagtattctttgcaacacttggatatgcaagtgaagttcatgtacaggcagataaagcaggcattgcagaggatgcagtatctacagtgattcctgatgcagttatttatatgccgtttgcagaacttgttgatgttgaaaaagaaattgcccgtcttgaaaaagaagcaggccgtctcgaaggagaaattaagcgtgcaaagggaatgctttctaatgagagatttgtaagcaaagcaccggcagcaaaggtagaggcagaaaaagaaaagttagagaagtatactgcaatggcagcacaggttgcggaacgtctttctcagcttaagaaataaatagcgataagaaggatttaggaatgatgacatacagcgaaatagaacgggagctcaacgagattccgaagttcggtgcaaaagcaagcctgtctaatctttccgcttatcttgaactggcgaatcacccggaaaggaatctccgggtgattcatattgcagggacaaatggtaagggatccgtcagtgcgtatattgattcgattttacggcaggcagggtatacgactgcattgtttacttcgcctcatttaataaaaattaatgaaagatttcgtattaattttaaagaatgttccgatgaagagctgatcaacgcctggtgcagtgtaaaagactatatggtgaagggcgaggagaaaggtttgcagtcgcttacgttctttgaaatacttttttttatgggcatgcttattttttcagaaaaagcaatagattattgtattttggagacaggacttggaggaagactggatgcaaccgttctttcaaatccggtactttctgtcataacttccattagttatgatcacacagaaattcttggcgatacgatagagcagattgcagcggaaaaagcaggaatcataaaagaggggattccggttgtcgcgattgatgaagaaaatggtgctttttcagtgatcgaaagaactgcgaaagaaaaaaatgcgcctgtttatgggctgaaatcgcaagagcttacaattttaaaaaaatgtgagaatacgattgatttttctatcaatagccgttattataagataagcaacttaaaagtaaaaagttatgcttcctatcaggtgcagaatgctgccttagcggtacttgccgtaaaggttcttttaccggaagtatcacaggatgtgataagagaaggaattgtaaagatgtactggcctggaaggatggaagagattgcagagaatgtttatgtggatggggcacataatccgggagcggttcatcagatttataacagtttgactgattctgataaggagtggctcttattatttgcagtttgttcagataaagattattctgagatgattcgtgtactaggcaggcttccctggaaaagaatatacattacaaagattgacagcgcaagaggagcggatactgctgcagtaaaacagtgttttaaagaagagacagcagggtgtccgatatacgaatacgataatgcaaggacagcatttgagacagctttaaaggatagagaatatgagaatcttttatgtctcggatcactgtatttggcaggagagattaaagattttgcgacaacaattttttgaaagtgaggatatatcatgtttgattttgatttagaattaaagaaatttaaaccagcagtaggtgttgagattggagaagatgaactttttagtgatgacgttaaagatatcactgatcttgtagaagaactggtatcagagcgtgaaggaaagaaagcttctaagtaaagctcatctgatagaaataaaagaaacaacagtctgatctaggaggaattcaatgaagtgtattaaatgtggtcggccagttggtgtgggaagatactgtaatgcctgcggctttgacaataaacacatagcgaaagcgttaaatactgcagattattattataacatcggtcttgaaaaggcgcagatgcatgatttaagtggagcggagatgtatttaaagaaggctcttacttataataagtctcataagaatgcaagaaatcttctcggtcttgtttataatgagatgggtgaaggtggcaaggcatatatccaatggaaagtcagtgcgaagctttcttccgtagaagagaacatcgcgaatctttatatcaaacagatggaagagcatccagcagtatttgaagagattaatgaaacagcaaagaagtataatgcagcactttcctatgcaaagcagggaagtgatgatcttgcgatgattcaggtaaagaaggtacttagtgtcactccgaacttcgtgaatgcacatttattatttgctttacttcatatgcgtgcaggtgataatgcctctgcacaggcagatttaaataatgcccttgcgattgacagatataatacgacagctcgtcggtatttaaaagaaatcggagagaatccggaaacagtggcagagaagattcctgcagatgctttaaagccggataatgagaatcttaaaaatgttcgtccagtagaccattatgaagatccgaataaagaaacatggaaacagtttgtttatatgttaattggtcttgcaatcggcgttgttgccatgtttgtacttgttattccaagcgttaaggcaagtgtaagtgttgattataataacttaaagaaggaatatagccagacaaccaataaaaaagatgcagagattaatacattaaaggatgataagaagagtcttcagaagaagaataagaagcttacaaagcgtcttaaagtatatgaaggttctaatggtgaggacagtatgtatgacagcatcttaaaggcaagtcaggcatactcaagcggtaactatgtagaatgtgcaaaacatcttttaaaagtagataaagactctttaccatcatctacggcaaagaagttatatacatccatgaaagataaggcattccagaatgcagctacacagttatataacagtggagatgcatcttataagtcttataagtatgaagatgccttagaagattttgagttatcttataagtatgataagagttacagtacacagtatcagatcgcaagatgttatacaaagctgaataagaatacagaaaaagcgaaagaatatttctatgatattattaataattccggagatagtgatctgattcgaaaagctgcgaactatggtcttggaatgacagtgaattctgcaaaagaagcagcagccaaagcaaagggtggcagcacgaagtcttctgattcaaagtcagacagtgatgatgacagcacagattcttctgaatccaagaagagcagttcaaagagtacaacagaagaggattttagtacagatactgctgatgataacgaataattattgctatttttaaaaacattataaataaaaataagttcgacagaatatgtcggacttatttttttgttttttatagaatgataccaggaccaaaaagtcagaaagggaggcagtgtcaaaatgaattgttgtcatgtaaaaaatcaatgtctggtcattcgtctgccaaaagaaattgatcattgtcaggcggagcaaataaggcaggaatgtgagagaagttttatgaactttattatccgggatattatttttgatttttcggatacctcatttatggatagttcaggaatcggattaatacttggaagggtgagacagattcatccgattaatggaaaagtatatttgtttggcgggaatgaaattattcgaaagatgctggaaatgtccggaatacagaatgtagttaccgttttagatacgattgaagaagtaaaggaggtatacgaatgagacaggcaggagaaacaggaaacagcttaaaaatggtgttccgaaatcatccggaaaatgaaagaattgtccggacaacggcagccgttttcgtatctatcttagacccgacactagaagaaatctcagattttaaaacagcagtttcagaagcagttactaatgctattattcacgcatatccagagtccggtggagatatcgaggcgtattttaagcgggaaaataaaaagattacagtgatcatcacagattatggtgtgggaatcaaagatgtgaaaaaatcaatgcagccattgtatacaacgttacatacacaagaacgctctggtatgggatttacattcatggaagctttctcagatgagataaccgtaaaaagtgaaccggggaaggggacaactgtaaaactcataaaaatcatgggaaagggggaagagtgtggagaggacctgtgaattgatcaggcaggcaaaagaaggaaataaaaaggcacaggaaatattagtagaagaaaatacaggattgatatggagtgtagtaaaacgttttcaggggcgagggtatgataaagaagatttgtttcagattggaagtattggtcttttaaaatgtattgacaactttgatcttgagagaaaagtaaagttttccacatatgctgttccgttaattatgggagaaatcaaacggtttttaagagacgatggtcttgtaaaagtaagtagaagtctgaaagaagcttcctataaaataaaaagagagaaagaacattatgaaaaattatataatagagaaccaacattaaaagaaatcgcaacaaccttagatatggatgaatccgatatccttatggctatggaatccggtcaggatgtatgttcacttcatcaggttatttaccagaatgaaggagatgaaattcatttagaagataaattggaacaacagtcggacttaattgagcagactgtagataatatatacatacaggaactactgcagaaattaaatgaacaggaaaggaaactaattgaacttcggtattttcaaaatcagacgcaggctgttattgccggaatcatggggatatctcaggtacaagtatcaagaatggaaaagaagatattagaaaaattacgaatgcattccttaaattaaacagagaaaaagaatttcagattatagctgtattgtggctgcaatctgaaattctttttttgtttgtgaataccacaaggaataaattctgtttagatatggtcagagcgaggaatgaaaatgcgtaagattggtataatataggataatgaatgtttttgaagattgcgagagtgcaaagcacatagcaatctggcatcaaaaggtcagtttacacgataaggagtttgacttagtgacatctttatatcgaaatgaggatgaaaaaataagcatgaaaaaatgagtatggagaaaacaattatttatttaaaagcggagcaaagttcttatgtggatcatgaaatgattcatatcggggatattgcttctgtctattgtggggataagaagaaggaagaggagattagaaatattattttgtacgagtttgatgagaacaaagaaaaagaaggacggatttttctctctattttgttcgtaattgaaaaaatatctgagcagattccatgtggtgaagttcgtaatgtgggagaattggatatggttgtgtattataagtctaaaaatgcagggaataagaaatgggtacagacagcgaaaattttatttatcggtgccacatgcttttttggaactggaattacggtgatgggatataacaacgatgtggatatggcaaaagtatttagacagttgtacagaacatttgtgggacagaaaccaggtggtcctacttttgtggaattgttctattccataggactggcattgggagtttttttgttcttcaatcatgttccgggaaaaaaagttacaaatgagccgacaccgatacaagtgcaaatgcggctttatgagcaggatgtaaaccagacttttttactgggtgcttcaaggaaaggggaagaactagatgtcgccggtaacagtcgtgattaataagattcttttaggctgggttgcctttggtgccggttttgcggtagcaggaggttttattgccttcatcagtctgatcggaatcgtaacaaggcttgcagggattacaaaaacagcagatcatatcccggtctatgaaaatagtatggctatgggaatccttctatttaatttattatccttgtatcaaccggtattttcctggatttttcctgtgaccggatacagcattatgtatctgtcaagtttgtttacagggatttttgcaggatgtcttgccggggcattggcagaagtggtaaatattattcctatcttttcacgcagggtaaaattaagaaaaggatttccttatatggtaaaagcggcagcgcttgggaaatgtataggctgtctgattcaattttatctttttaatctgtaagatatcagagtcaaaatacttttgccctggcatcatctgcaaaaatgaatacaaaaataagaatacttttataaaatcaggagatactttcaagaggtattcatgaaaaaatgacaagagctttaaagggggaaggaatatatgaaaaaggaacttacgaatcaggagtatgccaagagagtaaagcagttaacaccaaagtttagctccttttcaaattgctggcatgcatttgtatcaggaggtgccatctgtgttctgggtgaaatcatacgtcagattgcatataacaaagtgggagtaaatgaggaaaattcctatattgtagtcagcatctgcctggtatttttgagtgtgattctaactgggtttcaagtgtatgagccactggcaaaatggtgtggagccggaacgttagttccaattacaggatttgcgaactcggttgcctcaccagcgattgaatatcaaaaagaaggacaggtttttggaatcggcgtaaaaatttttacaatagcaggacctgttattttatatggtgtatttagcagctgggtagtaggagtaatctattggctcttttctagataaaatattttgcaaagtaattcccagtaatatataatgatattagggtcaaaagatattttgcccctaacttgatgccacgaattactccgtagctaactagactaccgtaattctgaaaataacagggaaaaggattccctgaatttcaagtcgagcagccgcgagacttggcgcgtgattctggtcagcgtaagctgacatattctttacagaatcactgcgcatcctcgcggagcgtttatctcagtcggaaattggactcccactgaga

SEQ ID NO: 466 - DNA, 13358 bp, Eubacterium hallii
gaagtttagtacctgatacagttacagatgagcatgtcttgtctgtaaagggtgctgtcagccaccctatgatgtaacgccactttagatagcaatatctatcggggattaaaggtcggaggtgtaagccgttagtacgactgggcagttacaagcccatgacctttaggtcgtgggtagttgactcgttgtcccttctaaaatgctttctattgtcttttttcaagtcgagcagccgcgagacttcgcgcggagcgtttatctcagtcagatattggactcccactgagacaaatttgctgtcactcaccacctgaaagaggtgggagtcttctcgactgagataaattttcttactattttaaatatttaaatattcaaataactttttcttaaataaacgcaaaagcttctcttttcaaaattacttctttgccgcattaaatgccttctgacatgcatctttgattgctttagaagaacaggtggctcctgctacagtatttacgccatctgcatttccatttgctataattttagaaatcattcctttctttgcatcgtttgtatatgctttattcgttgaatttgtatttgcggtaatgttggaaatttctgtaattttatcttttttaattgtgatatccatggaaatcgtatacggatcaaaatcctcatcttcatccggctcgcaggttatgcttactttgtatgttccatttttgtagtttttcccttcgtctggattttctgttgtttcttcttttttctctgtagtcgtttcctctttcttttctgtcgttgtctcttcctttttttctgtggtcgtttcctctttcttttctgttgtcgtctcttccttcttctccgttgttgtctcttctttcttttccgtagaagaactgtttttcttcgcctttgataaagcatcatttaccgcattaaaaatagcatgggaactgtacgttgctccactgacagcatctactccgcttgttccatttttagagacaataagtgatggaagatttttaatctcatctctgctcataaactgtttcaggtttgttccttttgctgtagaagaaatccccaccgcagaaatctttccatttttaatcgttacatttgccgttacactatattccttaaactgctctcccgaacaggccgcacttccggtataggtgccgtcttcatacccttctgccggtgctgtaatattattgttattattgctgtcggaatcactgttctttttcttattttttttgtttttcttctttttctttttcgtactgcttttccctgtttctgcctttgaaagagcatttcttactgctgtaataattccattggaactataggttgctccggatgccgcatccacatttgtagtctgtccgctgatcatctttgggataattccttttgccttactaaaataggaagcagtttctccggatgcgcttgttacatcaatcgcgctgatttttccatcttttactgttacttttacagaaatagttccaccaaatcctttgcctgaaccagtataagttccatccttccatgtaccggattcacttactttagaaacactcggagccgaaccacctgcattacctgcgttcgctgctgctgctgtcgcattattagactccgttccaaaaagtgcattttttactgcaccgataattccgtttgaactgtatgttgctccggacacgacatctacatctgtactctgtgccgtaagcatctcatcaataaccccttttgcacgctgaaagaaagaatccgtctcacccggagcgctgacaacatcaatcactgtcatcgtctttttgcttacagtaacatttactgtaacttttccgccatatccgtttgcagaacctttatacgttccatcttttacatcaatagctcccttctttcccttctttgttgtattctttttcgttgtttctgccattgctgctgtactttccttcgcaagcgcttccttaatctgactgatatcttctgtctctgaagcttcatacttttttgcctgtggggttttgtatccagtcagtaccgtcaccataagaaccgccaggcaaaccgctggaattatcgctgtaattcctttcacacctgaaactttatcaccaagacttttaaattttccaacatattttttccacttttctctcatcatgtctccccttctttttgaatgtatttttgtattcctatattctcgaaatctttttgtacttaattttatgagaaatttttgtatcacttttttttatttttatatcacttttttattatcgtaaaatcagactcactggtaaaataatctgcgattccctctgaaactaaaatactcccgtcatcttttacaagaatcgtgtcaaactcatcactgtgttctttccagtatttctgtgctttttccggtcccataatgaataatgatgtggataaaccgtctgcaagcgttccgtcatctgatacaatcgtaacagacgtcagaccattatttgccggatatccggtagccggatcaataatatgatgatatgttttgccgtcctgcttaaaataacgctcatatcctccagaagtaatcactgccttatcctttatagaaagcactccaatataacttcccgtatctgccggattctcaaccgccactctccagtcagaaccatctggctttccgtttagtgtctgcacattaccaccaagactgattactgcactagaaatcccattttctttaaaaatatccattacttttgaagaagtatatcctttcgcaattccaccaaggtcaatcttcattccttccttatttaaaatgacctcctgttttttctcatcatataaaacgtgatctgctcccatcagtccccttaacttcttcagctctttctttccgggaacacgatagttctccgtcgggaacccccacgcctgcataatcgggtaaatcgtaatgtcaaacactccattcgtgctgtcataaatctcttttgagcgcttaatcagatatcctgttgtttctgagacagagccttttccattctcgttaatctgtgaaacttcactgctgtcaatccccgtagaaacaagctgttcaatattgttaatctcatcaaccgccgcatccaacgctttcttagcattctttccgtaagccgttaaagtcatatacgtatccatcgcaaaaatatctcttgattctgatttgtcctcttcattttgagccttactatttgtatccgcttctgcctgtgttgtctgctccacagcctttctactatcattcttacttttctctgtatctcctgatgttccacatccggaaagcattcctgcagtgaacacagtggccagtaacatcgcaactgctttttttctaaaatttatcacaacaatcctccattatcttgaaacttacttgcattagttctttctaactttatacattatatagaaaatattctgacaatgcaatttttttataagcaaatgagaacttttttcattaatgcatatacagtttgacacaactaataatagtatattattatatttttcgttagaataagccaacttaaataccaattataatataaggaggaacttatgagaaacaaattacttgtagcaggtactcttgcccttgcaatgacttgtactactgtattttccagtattactccagcggttgtaaaagcagcaagtgtatctacagtacagacacagacagcagaaaatagtgatgactacgtttactgctatgcaggcctgacatgggctgaatattggaaggcagaaggagttacggcaacaggtgataccacttcttctgatacagctgattcacacgatgaaaaagataaaggtgcctttgatgctgtaacaagagctaccgctaatcacggtcttcatcgtggaagttatcagtgtactgcagttattgaaggtgaaaagggaacttatagtatatctcactggacagatgctaatactgcaatcctcactaatggagaaaaaatcacctttactaggggcgcaatcaaaaccagtgatggcactgaagatactatgaaagattataaagtttatggtcttaaatatgtacctgttgcagtaaagtcttctgattttgaagctttcagagcaaaatattccgttgtagaaaatgacggtaccttaattggcggctatgaagaaaacgatctaaaggcatatgaagttaccgcatctgtcgataagaataccaatggtctaaaaactgccgaaaagcagagcgacggttcctttacatttacccaaagaaataataacggctcttcttctggtattaaagatcaggatctcaaaactgctgatttaaacaacatgggagcaaccgtaaaagatgcaagcggtagctacggtgaatttcttcgtgtagatttcaaagaaaattacggcgatcttggtgctaatatgcaggctgtaaaatggacatactatggaaatgacagcacacgttctaaagcgcttgccacttacggaacaaagtttgctgctgataactggatgcataaaaaaatgggaatccaattaggtcttacagattccattcgctgtcagcttccagaaggaactgacggaaccggttactggagcttaactatttatgcccttggatacgctgattctacatataactttgaagctaccgatgcaaacattgtaaaacctgacacaaatgctggcgataaaactaagttaaacgaacttgtttcttctgttgaaggattaaacccatcggattatacagaaaagagctggaatagcttcgaaatagaattaaaagaagcaaaagatattttagcaaaagaggctcctactcaggcagaggttgatgaggcaattaaacatcttacagacgctaaaaatgctcttgataaactttatgtatacggaacagcgaatctttcttatgcagatttctattacggagaattaaatgatgtgaaagaggatgctgaaataaatcttgatgttgaagataaagcagcttcttatcgcgaaagaggtatgtatgatgcagtaagtagtgcaacaactaataaatacaaatctttcttctccagtacgtattcagaagataatacaaacggacagggtggctctattatcggtatgaaagacgtaaatatcgctgttccaacttcattatatgaaaatgcgaaaaaggctatttccgataagaaagaatgcagcaataaattattagaaattattaattctatgacgttatctgatacgacaccatctgaatataaaatcttaaatggtgatggtactttaacagctatgaaatctgaagttaccgaagatacttctgatacacttactatcaaaacacagtcttcctacggacaatatgaagtagatcctgtaacttctgaaaacagccctctttctaagttaagtgctaaagattccttacttggtatcattgttgaagacaaagatggtaataaatacggtatggaacatctggaaaacatctgggttggaggaaaattcgcctttgccgtaacagatggatttaaagaaaaacacggaaacacaattgattataagcgtcatgaagctttacaaggtaaaacaattaaaaaagttacttatcttgtaaaaaacggtgctgatattgttattaatactaacttaaaatgtaaaactttagctgggtctgacagcattaaagctaccgccaacgataactttaaagatggcgcaaccgtttctgttgatactactgctgttccttccggttctaattatactttaagcagcgtaagtatgggaaaaactgtcctgacagaaggtgcagattatacatacgcaaacaatactctgacgataaaagctacagatcatactggtgtaggttcctattctatggtatttacagataatacttactctgatattgtagcctccttcacattagaatctggctacaagactggagacatctccattaataaaaataatcagattactcttcctgccggtgtcagctttgaaaaatatgtaaataatattacatctattaaaattaatggggtagaaaaaacaggaaaaggcggaattaaagctactgatttatttgatgcagacggaaacattaacttcaatgcagcaattaaaggtaaagatggttcttctacacctgtatttgcagacaaatctgcttcttacacaatagagcttacatcaaccggttacccatctgtatctggaactgtacagctgaatacttctacccttgaagcttctatcaaaaaagcagaggcacttgatagcagcaaatatactgccgaaacctggaaagcacttcagactgctttaacagaagcaaaagaagcaaaatccgctaacacacaggcaattgttgatgctgcaaacacaaaacttacagaagctctttcagacttaaaagagaaaacagttactccttctaaacctgcaacagaaaagaaaaataacacgacaccagcattaaagaaagcaaatgtaaaactttctaaacctgttcttaaagttggaaaaacaacaaagaacaaagcaaaagttacatggaaaaaagttaagaaagctaccggttatgaaatccagtacacaacaaaaggattcggtaacaaaaaagctacaaaaacaattaaagtttccaaggctaagatcacatctgctcaacttaagaaactgaaaaagaaaacaagatataaagtccgcatccgcgccgtatatacagaagccggatatcagacagctacatcaaaatggtctgcaataatgactgtgaagacaaaataataattgtagatttcgtgtagacgaaaaaagaaatactggcatatcccatctgctctatagtcgctgtgtttaaaatgctcgttcgcatcttaaacacgctccgaagccgcatctgggatatgccagtatttcttttttctgactattttttctcgctgattttctcctgctattttgaaactacaaattcccacagagcacttaaattcaaggattttacatagtctttctctgtattaacacaaccgtctctatatgaccggtcgaagggaacatatctacaggctgaatctgtctgacactatatccattccctgtaagatgttttaaatcacgagcaagtgtttccggattacaggaaatatagacaattttctttggctttaagcgaagaagtgaatctaagaattttttatcacttccggcacgcggaggatccataaatactacatctgctttttctttatgtgatgccatttttaccatgaaatctccggcatcttctttataaaaacgaatattttttactttattctgcttcgcgttaaagacagcatcgcggacagcatctccatttaattctacagaaatgacttctccggcatgatcacttgccaccattccaatcgtaccaattccactgtaagcatcaatcactctttcttttccggtaagtcctgcaaattcaatcgctttattataaagtacttctgtctgtactggatttacctgataaaatgacttagatgagatacggaaagtctttccacaaagcacatcctcgatatatccttttccgtaaagaatctgctgtttatcaccaagaaccatactcgtatttctattatttacatttgccacgattgtcgtaatttccggatgttcttttctaagcgctttgacaaaattattctttgatgggaataccggagatgcagtaactaaaacaaccataatctgtccggtgtgatagccggttcgaactaaaatatgacgtaaaaagccatatccggtatcctcattgtaaggacgcattttaaatgacttcataagagaagttactgtattcataatagcatctgccttctgattctcgatcaggcaggaatctacacgaataacacggtggcttcgattctcataaattcctgtaaagcagtttccatgacggtctcctgctacaacaccatgcactttatttctgtaatgccatggatctttcattccgatgatcggctttacttttccaaaactgcttaaaagtttattcgtctctttctgcttcttttttaattgttcttcataaggcagatcaatatactgacaaccgccacatttcttttcataagggcattttttactcatcatatacctccaagctgcataaacgaaaaacgctcggagagcttacaccctccgagcgttcattcaagaaattaaatattggaaaaatacaattatttaactgtaactttagctccaacttcttctaactgtttcttgatgtcctcagcttcttctttagaaactgcttctttaagtaccttaggagcaccatcaactacagctttagcttcttttaatcctaatcctgtgatttcacgaacaactttgataactttaactttctgtccgccaacttctgttaactcaacgtcgaattcagtcttttcttctgctgcttctccagcacctgctcctgctgcaactacaacacctgctgctgcggatacaccaaattcttcttcacaagcttttactaaatcatttaattctaatacggataaacctttaataacttcgataatttcctgagttgtcatcttatttccctccataaatctttatattataatattaattattcagctgctgcttcggattctgcagctccaccatctttctgctctgcgatctgtttgattacgcgggcaaagtttgtaactggggactgaatgcttcccataaatttggcgataagttcgtctcttgatgggatagttgcgattgttgcaatacctgctgcatcgtagtaagtaccttctacaacaccgctctttaactcacagcattttgctttcttaataaagttagcaacgattcttgctggagctgttgcatcttctttggaaattgcaaatgcgtttgttccttccaaatcttttacaacgccttcgaattctgtaccttctacagcacgttttaccatagtgttcttataaactttataaacaacacctgcttcacgacactgtttacgaagttctgttacatcagctacggaaattccacggtaatctacaactaccatagatttcgctccgtcaagctgagccttaatctcgtcaacaataggctgttttaattctactttagccatcttcctggtgcacctccttaaatatttgtgtgtaccgccgtcagatcatctttcgatgaaataaaaaaactctctgtccaaagacaaagagcagaaatattctaagaataaaaatatctgaatataacttcctcggcaggtgttctcactttatgccttacggcacctgctgtcttcggcgttcatactttggtatgatagcatgggtgaaatgagatgtcaagtgttttttgaaaaaaagagacgaaagttaaaatctgcgatattataaaatgcttcgtatcacttcgtccaaactgctcaactgcagtttgaacttgctctaaggcgcatttttataatatcgcagattttaactttctgactttggatacagaaaaacactttttatttaataattatttccaaagaaatagtcatatggattcatatagccgtcactgctgtttccaccattgccattgtcatatccataaccaccattaccggaattgccattgctgtttcctgaatttccgttattgtttccattattggagtttccgttagaatttccattgttagagctatcgtcggactcgctgctgtcactggaattatccgttgttacatttttgaaatcactctttttaccaagtgttactgttactgttttttcttcgtaagttccgctctgatttgctctcttaaatgtaatcttaacctttgtatttgctttcttgatcgcaagcttttcttttaagccagacatagtagaaacgttgttaccttcaaacttcacaataacatctcctgctgagattcctgccttttctgccggagaaccgcttactacctgggatacgtaaattccgcttggaattccaagggcacttgaataagattcgttaatatcacgtcctactactccaaggaatgcagcatcctttgtacttacgctgccggcattcattaagtctgttaaaattgtcttggctgttgtgatcgggatggcatatcccataccttctactgatgtatcttctagtttggcgttgttgataccaactacctgaccatccatgttgataagtacaccaccgctgttaccagggttaattgctgcatctgtctgtaaaagattcattgtgccatctgttaaagatacttctcgattctttgcactgactacacctgtcgtaacagactggccatatcctaatgcattaccgattgctacaacttcttctcctacttttaaatcatcagaacttccaagtgttgcaactttaatctttgatgcagtagggtctttgatatcttttatctttacagaaataactgcaaggtctgcactggaatctgttcctacaactgtagcttttgctgttgtatcatctacaaagcctacagtaagagatgttgcatcagagactacgtgattatttgtcgcgatcataagggaatcttttgtctttgcaataataaatccagaaccggctccttctgattcctgtgttccaaatccatagtagtttgaagactgaatcgtacttgtaatagatacaacggatggcattacttcattaactacacttgcaacattctggctgtttgaaccacttccggaagaagtctctttcttagaacttgttgttcctgatgttgtctcaatcttatctgcagtggaaggataaaacttatcctttactacagaaacaccaacaaagcaagttcctgctacaagaccaaaaattgctgcggaagcaaccagctttgcaatctttttacctattccacttccatttttattattatcgtcattctttctttttcttcgtctcttatccggttccggtggaatgttactataataattgctgttattattgtaagtattgctataattgtcattataactatcgctataagagttaccataatgactgtcatcgccataatcatatcgactggaatttccgccggttccctgttctttataagaatatctatgactttctgcctgctcatgtactgccgtttcttctgtcggtgttacatctacagtaagctctccgttattatatcctccgttactatattcttcattactatttacttcatttatcggattgttctctacattctcattatggaatccgttattattttcaaattcgttcataatgttttcccctttctctaagtttgtaaccttatattagcaacgatgtgtgatgaatttgtgttgtatttatggcaaaattatggatttataccctttttgtatgttttcacacttttttcgtaaatcggcgaaaagaattgaccttgtagaatgacttattctattgtataataagttagaaaattatcccagtaatatatatacataactttactggtgatggaggtacacttttatgattaaagagaatcaaaaatatcttaaccggtttcacgttgtcttagacgcactggttatttattgttcgttctgtcttagttactatattcgatatatatgtcctcttttcaaggatatttttcctcgttttggttactggagacagctatggcaataccaaggtatacttctcgttctaattcctgtataccttattttatatgcaaagtttaacttatataaaccaaaaagatttcagaatcagactgccgagtatgccaatcttgttaaggcgaattcgatcggaatggttttcttctttatatatattatatttatgaagattccacacgtctcaagaagtcttcaactgatgttctatgtactttccatgcttcttacaattgcagaacgcgcagcgatccgttatgcattagaaaggacccgccggaaaggatataatcttaagcacgttgttgttattggattcagtgctgctgcagaagcttatattgatcgtattaagtccaatccgcagtggggatatacgattcatggtattttcgatgataatctccgatcggatttttcttatcgtaataccttctgtattggtaaattaaaagatgttgaaaagtttttgcagaatacttccatggatgaagtggctatcgcattaagcctgaaggaatattataagcttggggaaatggttgctgtctgtgagaagtccggcgtgcatacaaagtttgtcccggattattataagtttatttccactaacccagtaacagaagatctgaatggacttccggttattaatatccgtaatgttcctcttacaaatacagtgaataagtgtatcaagcgtctgatggatattgtcggatctctcgtatgcatcattctcttttcaccgattatggctattgttgccgtccttgtaaagaagagttctccgggcccgattattttttgccaggaaagagtcggtcttcataacaaaccttttaaaatgtacaagttccgttctatgggtgtacagtctgcttcaaaagaacaaaaggcttggactgttcataacgaccctcgtgtcacaccggtaggaaagatcatccgtaagaccagccttgatgaacttcctcagctttttaatgtattaaaaggagatatgagtctgatcggacctcgccctgagcgccctcttttcgttgaaaagttcaaagaagagattccacgctatatgataaagcaccaggttcgtcccggcatgaccggttgggcacaggtttgtggttttcgtggagatacttctattgaaggacgtattgaacatgatattttctatattgaaaactggacactttcttttgatatcaagattttattccttactgtatttaaaggatttgtcaataaaaatgcttactagtgtactgtatcattgacaaacattcatgacgcagccgtacactaagcctagaaaggacgcatatttattgtcaactacccacgacctaaaggtcatgggcttgtaactgcccagtcgtactaacggattacacctccgacctttaattcccgatagatattgctatctaaagtggcgttacatcatagggtggctgacagcaccctttacagacaagacatgctcatctgtaactgtatcaggtactaaacttcccatgctatacagtaaaaaaa

SEQ ID NO: 467 - DNA, 12566 bp, Eubacterium hallii
tccatgcactggcttctttcctgcttttacagtatttattacgtccagaaaaaacaaactcgttattttcccttgtccattcctgtacatcaaatggaaagtctatgcgacctgtatccataatctcatactttttatcctgtaaaacttctggttcttctttatgtatcaacgcagtgatctgtttccgttctacaggtgtcaggtctaagtggttttcaagatacggcaaaaagttttcattatactttgtgagttgttctatcttttcctctaatatgccatcttcctcccagtattgtctatacatacaatctggggacagacagtaatcataatattcctggatatgttctatcagggactttccttcacttcctatgtcatatcttccctggaaagaatattcttctccatttataattgcataaatagaaaatgccgtcttgtaataagaataaccttctccctcattctcctgctgctccatctcctgttcatctaactccgcaaacagtctgtttgctgccgcaaaagacattttagcagtaacataggctttcttttccttatcatagtggcttaaaatatcatgttcagagaaatcaatctggaactgaatggtatctgcctttttttcttcctgtgtaccgaaattcggcacgttctcccttgtttctgtttttgcttcctgatgtatatacggatactctttattttctattaaagtacggatacgtttttctgcttctttccatgtcagtttcttttgtacgtttcctttttctaaatgaaatcctttggcatcgtgccattcgtttgaattccggctttctgatatagaatgggaatgacctcccataccatactcctgtttcaggaaattaattgctgttttggtatccggcgcaggctcctgttgatagaaagaaagtattcttctttttcctccctcaacaatacctccttcctgcaataatctatctatctcatctgctgtgataaataccattggagctatttcctgtacattttgtggaacaagaggagacagattccctaacttatagagtctctctgccagattctcacatcttttttcctgccattggcttatgctacctgctctagctgttccaaaaagtgaaatctcatcgtataacttttttatactggcagtcgcttttaactcctcaatgattgatatgacagcttcactatggatgtttccccatcgggactgtcccatatcttctttataaaaaaatgcaataagtcctgccgtttcttcccgaatcgtacttattgcattttctgataattctcttgtggtaaactgcccttttctataaagaatttctatccgttcggcagcttcctcccatgataacagcctttcaggattctttcttgcaccattgcctctgcgaaaagaaatcccttcttcgttataccagacactcacttttatgccgtctggcattgcaagcccttttccacctttccagttttcttttaaatcttttgcaagtattttttgagggttttcctgtgccagatcaagcaggacatactctaacgaaagttcattgttaccacctgttctcagacattcatcaatatagttatccgggaatgcaaaaacagcagcaggtgtattacctgctgctgttccatactcagcttgctcttgtggattttccgggaaaaggcttaactgtatataatctcttctttgattatctcctccgcctgctgtttgcagttgtttacgagtccgacccacttcatctgatcggctgccttcagttcctctgttgctcctgctatcttcatcagttctggcatcagttcgtccattctctcctctgcctgtttctgaatgtctatcatatgttgattgatttccccggtcatcatcatcgccgtataccttgatttccgatgctgctccagataatcggctctcattactccgtatttcccgatgtatcccttcggagcttcctttaattccagatccggatacagcagtccgtcctccttctttgtgtatgtcaacgtcatttctgttcacccctctcttttgttcctgtgttttattatctttattatattccctttgattgctttgtacaatagactctgctctgtttttttgtaaatttttctgccacaaataccgggatatatctttcaatacaaaagaacattgctcacttacaggtgttcctaaacaagaaatcacattgatattattaaaatcagtaattgcccgaaaatcctctaaatacatatagtctccgggttctatcccacatcgtcttaaaagcatataccaggcagaatgaataaataactcccgatattctttgcggatagtatctatatctaaatcttcaagataagacccttgtttttccttcaagatttctgatatttcatcatctatcacatcattaaccgtttcttctattaattgttttaataccaaacctaaatctttattttgtggtcgtatatcgtatttattattaatatagtcacataaatcttcctgcccgtcttctcccaaactccagatataaggttttcttatatcggtttctggaacattggaagccacccctgtatcactataatcatatacataacgaagctttctattttcgctatttctgacaataagggcaattccttgtgttccccttttaacatagtgattcatttgtttccacttttcaaagcttgtacatcctattgcatttggtcgctgggcatagatcataagctgggcatcaaaagtatactgatatacacgagatgctgtatttaaaaactttagccattcctgtggtgtagaagaaacttttcggacagtttcttcaaacaggtcttctgcagttggtaatgtcattgccatacatcattcccccctttataatcttggagcctgttcctgttttttaggttttgataaggataactcttcttttttattaaaatgattctccagatattttacggcttttcttacctcccggttttctttgtaacgaggaactgcatctaacatttcccggcagattctcccgcctgccagtagatcacattttccagaatacatatcgtcatctggaaaatgcaggtcaataccgattccttttacaccattaagccgttcgcccggtattttttcatagatggcgattgcttcagcaagtgttaaaccgtcataatattcgcccagtgtcggaaactctgaacattctgcgacataaaaatcaacctctggtatcgtttcaggttctcttccaaagatagataatctttcgagtttctccatctggataaacatatcctttccttttttcacatcactttctgtttccgatttttctgttgctttcagaaaatccttaatataatccgattttttgtgtaaaatatcttctgtgattgcatctgctgcttcttcctggctcatcgttttatagacatacagattatcataagaacgtgctagagaatccacttctatcgcaaagtttttaatctccatctcatccagataatattctgcccgttgcatgtattcagataatgtcccggatttttcttttcgtatgggattaatatctattggaatattcctggcatataacatatcttcttttaaataattaaaaaacgtatcctcacttattgtcccttcataactaagagcaacatcaatatcagaatccggtctgtataaaccttccctgctgcgtgaaccgtatactcttgctccaattaactctacttcatcatgtaatcccagttcatctaatatgatctgtgcctgcgacaggacaatctcctcaatatctgcccggctcatcccatttaaagatttttcctcataatacacttctgatgtaagagcaacatctccttcctgtaaacgtcttttagattcctgaatcactgactctaataatcctgcttcttctgcttcttcaatttcctgttctaatttttcatagtcagtttcttttatattttcaatcgtttctccagcatcatttaatatatcctctatggcttctttcagggaaacatccagattatcgtaaatacctccatccagttcctgatactcctggtcataaaaagtataatcatatccttcatccgtctcatggatgagaaagtatcctttatctgctgacaagatataggcagcttcttttttgtcatgaagtgatttgtctaataaatattctccgatcaatttcatcgcttctggactaaatccatgccataaatcttctgcaataacctgtccttgttcatttacaataatatctgcaacctgttctccaaattcatcatgccgcatctgaaaaaatttctcattgtgaaattcctgcatctgtattgaatgccatgttccaaagtgtccttcagctgtaaaaccctttgttgattctgttatctgttctactactcttaacgacggctctttataaaaatcaggcaacggaacaaaccctatcatgtccacgtaagagacatttacttttccatttctttttatcaaaataatgtcacttacagagagggaatgtcctgtaaaatcatcagggtgtgcaatattaaattttgtaaacaggctgtctctattttcatctgctcctaaaatatcactgtaaacaagctgatactctgttcgctctggtacttttccttttgaacgtaaagaatcaaaagaaaggaaagcataatctcttcctgcacctttcctgttaacctgatagattccataggcatcttcttttccatgcaggatttcttcctctgtcagcctgccacccgtttgttctatctttaccattattgtcccctccgtttctttcttacttgtcttaatctctgcatcattgcaggagtaagacttgcagaagcatatgttttcatttcctcaacagtgtcaccttcttcgagacatttgattaagaattctttttgtgcttcattaaatgtatcgcctgccagatacgtttcaataaatctatccggctccttcgatctcttttcttctttattgaaaaaatgccagcgtttctttttttcggttacatctcttactgaattttcttttttagacggtacctctttttgctcttccttatcatcgtcagatgattttttttcttctaactgtaaaagaagtgtcttcttttctgtttgccatatttttttattctgctctatctcattcactagactttgtatcttttcatctctttcttttattaattcctcttttgctgccaaagagttttgataggattccctttgttccgtaagggcatttttttgtatatctaacgtctgctgcaatgtagcgttcaatgttattcttaattcttccgtctcctgaaacaccttaccagctttatcatgtaactctgaaatctgcttttgcatttctgaattaggtacgaatatgttttccagaaaattcagccgttcttctttgatgtgtttaattttaacccgccagtcctgaacagcaatgctatcaatccgacgtatctcttccacagtcattccatctaatgcacatatgcagtagtattcccggaatacatcgtcatctatctcatccaaataggcaagcatttcagccgtacagtttgcttcctgcaaaaccttcctctgaaattctatgatgatatttttttcctcctcttgttccatttattttcacctcctgtgccgaatttcggtacgttctgtttttgaaatcctctgctctttattcagacttctttcttcttcaacgattcggtttacaatccgtttttcatgacgaatttcccgaagtattgcattaatctgctgtctttcttctccagcttttaacattccttcgggtatctgtttcaagaacatatttaattcctcttgatatatttcaaatcggtcatcccaatctggagtatcagacagacgttttttcaaagccctgtactgccttaacatttctttatcttccactgaacggagagaactccggcggttcatcaactgcttctcttttgccagtaaagcattttgtttttctaataaatcatcctctgtcttaatgttgttttttagaatgtatttgcattcttcatataactcattaatccgaatggcatttttccgcacatctttttgatttactgcataaggatttttcccttcaagataatgccctgcttgataaaaaattttgatttttttaatctgaaatatcgtaagtgtctctgtatattgaaagatttctctttcatatttcttagacaatttagaggacagaatactttctgcccccttttcctttcctttgttttgaatcctctcttggatttcttctttcctgtatcctgtaccaagacgggaatctctccgtccccgttcaaaaccgggtgggatatatgtcacatacttcccttgacggattttatatcctagactttccatttgcttcacaaaatcgttccaatcttctgacatagcaatcacaaagtctatgtctgccttaataattttttcagatgatggtctgccctctttctctgcataatgtgctgcataagatttccctatcttattatgtgggtcataaaccagtggcggcagaccatatttttcacaaacacggtctgtaattggctggatatatttttcccagtctcctttttcataacggtacttatacccatccattcggttgacagaattaaaaacaatatgtccatgcatatgtttttgatcagtgtgaatagagaacacataatcaaaattttctccaagatattcttcgcaaaaatcatttattaccgcatatgcttcttcttttgtcgcttcccccggtggaaatgagataacgaaatgatagccttgccttccattttctttttcccattcttgctttgtatccatcattacttgataaacttcctgcggagtagttcctgcatttcctccaaccagtccctctgttttatcagaatttaagatatacgaaatacaattttttaaatgtgccgccccacctccctgtggtgttccaatattcgatagcttagtgattgccataatcctctaccttctcattaagcgttttcatctcatgctttacctgctctaatgctttttcaagattataaatatcaatctgattgccataaccagcattaatttttgcaacaacctgattgatgttgactcctattttacgcacttggtaggaaagagtttttaactcttttttcaagctgacaggattatcgtcctgtaaaaaaatacacttccgtatatatgcagaagtgtttgctttttctcccttttttgtttttgtttcggggtcattctccgctttagctaaaagtaattgatactctttttctgtcagccggaggtcgaatctccttttccttatttgtcctcaccttcttgttctttttcctctattgattcttcctctgattctttttcttcagtaaattcagacatgtacatatccaaaactgtttttaaatcttcgatttttttagcatccatcggtccaagatattccgtaacgatttctgcaagctgtttattttcttcattctctttctgttcttttgcttttctcagtttttcttctacctctttttttctttctgcaagtctgttttctttctctattaattttttaagctcatcctctaatttttcaatctgtttattccaatccatctcatcaatctccttctttgtttttcttttcaagtgcatctatttttgcttgtagattttttacctctgcctgcagtgctttcctttttaataattcatactgtgacacctctgtaatctgatttggatattcataacggcagagtgtatatttttcttcatcatcatctcctcttggtgatggatattttcgatacatcttataccatttttcaagaaaatcattgataatactatcgctgtcaaattttaaatagtatccgtcctctttcttaaccgggtgcaatccgtgaaaatcttccatatcaaatagtgcgtaaaacatttcctgataggaaagcatatctgcatggatcaaagcaccttcaccaactcctaaagcattacacatatctttcaagattttttctcttggaatttttttatttttttcatactgtgcgatccttacatctgcagatgaaaaagaaaagccacacatcacacctaattctttttgtgtgtacttacgcagcatacggatttttttaatcttttgccccagagaaccgggagatacccaattttcttttttgcattctatgatttgctttatccaatccatctcatccatcctttagaatttattttaggaaatctggttttccataaagttctttcttctctgcatcgcttgaaaaggaaatattttttttgcttgcatcttcctcaagctttttttcaattctatccagtttatcctgtatatcttctaattcatccataacattttccgtttcttcttttttaaaaaagttccgtacagcttctgtaatatatacattttctgtaggatacatttctttatccctattatttatcatcgccagaacatcttctggaagacggaaatgtttctgctttaccatttttccctccacaatttctcacctttcttatacattatttagtctttattccataatatatatgtaccatttctggtatttcctctgctttcgcatataccattttgggtatccatataccacttttggtatttaggctgtttttcatataccatttctggtatttctcttactttcgcatataccatttttggtattcatgtaccactttcggtatttttcatataccatttctggtattacctacataccaattctggtatttataccaaaaatggtacaaataagccgataggcttattgcaagatacgcattttgtacacacaaaatacatcttgttaggggggaaacccctaaaaccccctttcaacaaccaacggcatctgcacccccttctttcaatgctgaccagaggaatttatccattcctccacagccttatcatataagttttgcatctgtgccgcatatttattttgaaagaaaagataaaaagaatctgcagcttcgcctgcattttctaaaaggatttttgcttcttcggctccgcactttttctttaatctttcaaaaaattttttcttaatattgatttcctcagcccggataatcagatttgttttagacccaagtgtacagtccattaaaaatttttcgtatgcaaatgtgaaatcttcctccaaaatttcaccgcctttctttttctctccctgtattattctagtgaaaatgtataggtaccatcttcaaaagttaccgtgatgttttttccgtcacttctttttgttacaaaatccagtacagctttataatttttctcccctgtattttcaacagaagcaacataaaaatttcttcgttcttccccttccttctccaaaaattttagtaattcctgtgacaattctttttcatcggctaccgcacctaatgaatcatcctggtctacgatattgggttctccaaaattgattggttcagtcccaatttcgttatactcttcttcatcatcttgcatcgtatttttttcctgtggcatccctccataatcttcgatactttcaatcttctttttatatggggcaaacgaaaagatttcttttctcttatcgtaggaaataagaataacagaattatcatcatcatctagttgtagataaaatgttgctgtccctgcattactcgacacatcatcatcatactttgaaagggcattgatccattgtacgtttttataatttttctcaacatactctgctgcctgttcttcaaaatctgtttcattctcagaatttatataatagatatattccagatttgtgaaatgatatttttctcttttttctttttctgtctgttctgcagtatcttctgtcttttgttgttccgttggattttccctgctgttttgattttttttgggaacaaaaaaacatatagcggaaataagtaaagcgaaacccagaaagacagccaatagaaatagcattatctttttcttcatcctgctcctttcctgtaccgaatttcggcacattttcattattatctcaaatgattttttccaagattaactgctttaacaacccggctttttgcccattctggatgaaacctcgtgacggtttttcctgtatgataccacatggatttatttacaacaaactcaacgacactgtgtccaccatcatgtccccatttgttgcatcctgcatcagacatatttttttcatcacccataacgccatgtatgactctgccatttgccagaacaaaatctatctcatctccgatctttccgaaagttggagtgcaggctatcacgtatctgtcaccaatctttccgaaaccattcgcatcataatgctcacctgttttcacacgcagcttatactggttacttcctgttgacgtaatgagtgaccatcccatgtatgtaaaactgtctccatacggcgatgggatattggttgtttttcctgaaccatagctgtcctggtcttttacccggaggatcactgtgatgaccgcccagttgatttctcctttacggacagactttacaaaaacacttcccggctttttgtcttttgtctggtcacgtccaaaatcataccagtatgttttaccgttctcatcttttccggcatagatgttcgtatgccctttgaaaaggcaaatatcccccggctttaagtcgaggtcttttgattttttcccgccagtctttatgatgtcaaatcctttttcaatctgctttcttacggttccgttacagcttaattctcccgatttatttccgaaaaatatctgtccttttttcagaagtccaacttcctgaagcacaagacagacaccgtgggcacagtttgttctttttgcagattgttcagccgcagcaagggaaccctttagatcgtaattggaatacacccatttttcatccaccatcattttaccaagctcctgtgcttttgataagatctctgatgctgtcgaggaagtgagtccttcgtctggataatccggagtaccgtatcccatgatgcctttataagtaagctcataatgtccacgcatgacctgattatttttatttccttctatggtatgtacgattccattttcaacgtactcaacgataccaacatgatgagattctcccaccccgcctctatcaaaatagataatatctcctgcctgtggagtataacttcctgctttttgatactgctgcttatggataaaccattgccgtcctgtctcgcaggcggctgtctttggtatgatattgctctcgataaacccacattcattcgcacaccacgaaacaaaggcatggcaccaggacattccgtctgttcctgtatacactccatactttgtatgatttcctgccccttcgtgataacctatttcctgtacagcgaccgcaacaatacttgccccggaacccgatgcataatctgtattatctactgcggctgcaaaacctgacagcaaagtgatgatgattccaaggaaagatacgatcacaatgatcggtattaacaggatcaacaaaacaaaaaagatcgtcacggcaatctgtgcagcaaagtacatcactgtaactacgacagaagcaagcatggctgcggctgccacgccagggcttcctgttttattttcttcgatgagctgggataacttcgtctgcgtttttatcctctggctttcgatcgctgtatttttctgctgcagcatttctttgaaattttctgccgttttttttgcgaccagtgcagccagaccagcacccgtagatgcagctgctgtatccactgtttttgctgtagcatttcctgcagcttttgctgtttctgcggaagcagaagaagcaatatctactgccttttctcctccggcaacggtactctgggaacggatagctgcccggctgtcccttgatttcgatgcgatctctccatttccaccatggctgccgatctcttttttatcaacaggttctttccatgtacttgattgatattttctttcctttgaaaagatttttgccgcctgcttttctttttcctggacggaactgggttctgtctttgcaatcccgttccgttttttctgccgttttaactgccgttctgcctgcctgatataacgctgctttgcggtataagacagccttttccattcttttttttcttttttggaaagataatgggcagggtctatgctgacattttcgttcccctgttcctgttcctcatttccattaagagggtcggtgttcttcactttctggatagcactctgggaagtagcaaacgcactgtccatttttttaaaactcgcttcttttgctttttttactgcca

SEQ ID NO: 468 - DNA, 12402 bp, Eubacterium hallii
atttgccgggaaatacgataaagaactcagaggatggaactacgagcttatcagtgaaaatgtatgcagacatctttctgatacgaaaactccgcagggagtcatcgcagtagtacgaaaagaagaacctgccattgaagaactcatcaataaagaaaagaatccatgcttttttctcttagaaagtcttcaggatccgggtaatcttggaacaattgtaagaacagcagaaggcgccggagtaacaggaatcatcatgaacaaagaaacggtggatatttataatcccaaggtaattcgttctacgatgggagcgattttccgagttccttttgttattacgtatgatcttcctcaagtagttgaacaattaaaacagaaaggaatttctgtgtatgcaggacacttaaaaggagatgtgttttataagcaggattatcgaaatggcagtgctttccttataggtaatgagggaaatggacttacagatgagattactgctttagcagatcataagataaagattccgatgaaaggaaaggtagaatctttaaatgcagcagtgtctgccacgattcttatgtacgaaacaatgcgtcagagagaatttgtatccgatctgcagtagaagtgtgtcatgcgctgcaggacgcacttctcgtagcaagaatgccgggatattcttggaagtggtcatacaaaatgtagtatgattaaataaaaaagaatcaataaagtagacaaaacgaccattcaaataaaattgttaaaaaaataattatttaatctgctttaaaaacgacaaaaaaattgtgcattatcatgcaaaaacacaaaagaaacatacaaaaaatgtaaattgtctaaatacatcgcacagaaattatgttaatataagagcagaggtcaggaaggtattgggcttgaccacaacgtaatgaattattttaaggagggtttacttatggctaagtacatgatggcgttagacgcaggaacaactagtaaccgttgtatcttatttaatgaaaaaggtgagatctgtagtgtagcgcaggaagaatttacacagtattatccacagccaggctgggtagagcatgatgcaaaggagatctggcatacacagttatctgttgcacgtcaggctatggaaaaacttggtgttacagcagctgatatcgctggtatcggtattactaaccagcgtgaaacaactatcgtttgggatagagaaacaggaatgccaatctatcatgcaatcgtttggcagtgccgtcgtacatctgaatactgcgattccttaaaggaaagaggattagtagataagatcagagaaaaaacaggtcttgttattgatgcttacttctcaggaacaaagattcactggattcttgaaaacgtacctggagcaagagaaaaagctgaaaaaggcgagttaatgtttggtacagttgatacatggttaatctacaacctgtctggaagaaagattcatgtaacagactactctaacgcagcaagaacaatgttatttaacattaatactcttcagtgggatgatgagattttagcagaattagatattcctaaatcaatgcttccaacaccgaaaccatcaagtgaaatttatggtatgacagatgagagcctcttccagggaagaattcctatcgctggagcagcaggtgatcagcaggcagctttatttggacagacatgtttcaatcctggtgaagctaagaatacatacggaactggtacattcatgttaatgaatatcggtaaagaagttaaattatctgagaatggtcttgtaactacaattgcatggggacttgacggcgaagttaactacgcattagaaggttctgtattcgtagcaggtgcagctatccagtggttacgtgatgaagttaagattgtagacgcagctccagattctgaattcttctgtaacaaagttccagatacaaacggatgttatgtagttcctgcatttacaggacttggagctcctcattgggatcagtacgctcgtggatgtattgtaggtcttacacgtggatgtaacaaagcgcacatcattcgtgctacagtagaatctcttgcatatcagacatatgatatccttgaagctatgcaggctgatgcaggcgttaagttagcagctcttaaggttgatggtggagcttgtaagaatgacttcttaatgcagttccaggcagatatcattgatgctcctgtacatcgtccacagtgtgttgagacaacagctatgggtgctgcatatcttgcaggtcttgcagttggatattggaacagtaaagaagacgttatcgctaactgggctattgataaagtatttgaccctgagatggacgatgataaccgtaagaaattacttaaaggctggaagaaagccgttaagtgttcctacggatgggcaaaagaagattagttagacttgatttgattaataagaattagccatttagttacataataaaatgcaagaagggatccatttataaaatgggtctctttttgcgtgtcagatttttctcttttaagctcatgtattcctgagtacagaaagacactgagagtgcattaaatttgtatttatctggttattcacttgattatgaataataaatatgataaattcagagattagaaagagttgtaaaacgataaggagattgaagtatggcaaatataatttcagatgaaacaatcgaatatgtcggaatccttgccaagttggaactttctgaggaagaaaaggaacaggcaaagaaagatatggcaaatatgcttgactatattgatacattgaatgaacttgataccagtggagtagagccgatgagtcacgtatttccagtgaataatgtgtttagagaagacgttgttacaaatgaagatgacagagatgagattctggcgaatgcgccggaagccaaggacggagcgtttgtagttccaaagacttttgattaggaggaaagatatggggcttatggattatacagctgttgagctgggtaagaagattaaagcaggagaagtatctgttttagaagctgcgaatgcggctatggatgctattaatgctctagaagataactttaattgttatgtaactgtacaggaaagagaagctatacaggcaaaagcggaagaacttcagaagaagattgatgatggaattcttacaggaccgcttgctggtgttccggttgcagtgaaggataatatgtgtacaaaaggaactcgcacaacctgtagttctaagattctcgagaactttgagccaacttatactgccgaggcagttctgaatcttgagaaggcaggcgcgcttattattggtaaaaccaatatggatgagttcgcgatgggcagtacaacagaaacttctcattatggagtgacaaagaacccatggaatgcagaacatgtaccaggtggttcttcaggtggttcggcagcggcagttgcagcaggagagtgtagttacgcgttaggttcagatacgggtggatcgattcgtcagccggcttcttattgtggtattgtcggaatgaagcctacgtatggtacggtttcacgttatggactcattgcatatggttcttctcttgatcagatcggaccgatggcgaaggatgtaacggactgtgcaactattcttgaaacaatcgcatcctatgacccgaaagattctacttctgtcaagagagaagattatgattttacatctgctttaacagaggatgtaaaaggaatgcgcattggaatcccaaaagattatatgggagaaggactggatgaggaagtaaaggcagctgttcttttagccgcaaagaagttagaagaaaaaggtgccattgtagaagagtttgatttaagccttgttgaatatgcaattcctgcctattacgttattgcttctgcagaggcaagttctaatcttgcacgttttgatggtgtgaaatatggatatcgtacagaaagctacgaaggacttcataatatgtataaaaagactcgttccgaaggctttggacctgaggtaaagagaagaattatgcttggttctttcgtgttaagttcaggttattatgatgcatattacttaaaagcgcttcgtacaaaggcattaattaaacaggcatttgataaagcatttgaaaagtatgatgtcattttaggaccggcagcaccaacaacggcaccgaagcttggagagagcttaagtgatccgattaaaatgtacctgggagatatctataccatttctgtaaaccttgcaggtcttccgggaatcagcgtaccgggcagtcttgacagcaaaggccttccgatcggtatccagtttatcggtgattgctttaaagaaaaaaatattattcgtgcagcatatgcatttgagcagagtcgtgaatttgtaaattggagtctgaacggaaaggaggaaaagtagaatgagtaaacaatatgaaacggtcatcggtctggaagttcatgtagaactggcgacaaaaacaaagattttctgtggatgcagcactgcttttggtggtgctcctaatacacatacctgcccggtctgtacaggtatgcctggttcccttcctgtattaaataagcaggttgtagagtatgccgctgctgtaggtcttgcaacaaattgtacgattacacagtactgcaagtttgatcgtaagaactatttttatccggacaatccgcagaactatcagatttctcagctctatcttccaatttgccgcaacggacaggtagagattaatgtagacggaagaaagaagaatgtaagaatccatgagattcatatggaagaagatgccggaaagttagtacatgatccatctacaggtaattccttagtagattttaaccgaagtggtgttccgctgatcgagattgtatcagagccggatatgcgctcggcagaagaagttatcgcataccttgaaaaacttcgcatgatcatccagtatcttggagcatctgattgtaagcttcaggaaggatccatgagagcagatgttaacttatctgtccgcgaagtgggagcgaaagagttcggaacaagaacagagatgaagaacttaaactccttcagcgcaatcgcaagagcaattgagggcgagatggaacgccagattgacttaattgaagatggtaagaaagttgtacaggaaacaagaagatgggatgatgataaagaatattcttatccgatgcgttccaaagaagatgcacaggattatcgttacttcccggaaccggacctcgcaccaatcgtaatttcagatgaatggttagatgagattcgcagtcgtcagccagaatttcgtgatgaaaaacaggcacgttataaagaacagtttggccttcctgaatatgatatcaatatcattacagaagataaaacacttaccgacttatttgaatcctgcatcgaactgggtgcagctgcaaaagaagtatcgaactggattatgggagacattatgcgtctcttaaaagaaaaagaaatggaagcttctgacatacatttcagtccagcaaatcttgttaaaatgattcagatgattgaatctggtgcaatcaaccgtaaagtagccaagaaggtatttgaggcaatctttgacgaggatgtagatccagaagtttatgtagaagagaacggattaaagactgtaaatgatgaaggcgcattacgaaaggtaatcgaagaaatcgttgcgaataatccaaagtctgtagaagactataaagctggaaagaagaaagcaatgggattttttgtaggtcagaccatgagagccatgaaaggaaaagcagacccggcaatggtgaatcagattctcaaagaaatattagattaatactaatctgtagatttcatgtagacgaaaaaagaaataataccatatcccatctgctctgtagtcgctgtgtttaaaatgcttgttcgcattttaaacacgctccgaagccgcatctgggatatggtattatttcttttttctgactatacaaaacttacagttggtgagaattagtatttttgtttgaggaaaacatggagtttctccaaaagtctatggattttgttaggagaattttttctctggttaactctcataatcttctgggcaatttccttattcccatccaagctttaaatactaatttccatctggagccaaacaacagaaaagtagaaatttaatagaaaaggaaatgtgatgtcggagcgaataaaaatgccggtcaggcattttctacgaagcgactatctttacattttcttttctattaaatttctgcttttcgtttctttagtccctcaaattagtatttagaaaggaatatttatgtgtgaaaagaaagtacctgtattaaattttatgacgaagaatcgagatactcgttttttaaaaagctatacattgaattatacaaatacagaaggcaatgaaaaattatatgaaatggtaagtaactttgattatgaaaagccggaggaaattggaaagaaagcttctggtgtggtaattgtgggcttttatggagagaaacttcttcttttgcgagagtttcgcatgggggtgaatcagtttatctacaacatgccggcaggacatttagaagaaggagaatcgatagaagagtgtgccgggcgggagctaagagaagaaacaggactttacatcaaaaaaatctgtaaaatactcccgccagcctatgctgcaccagatttaagtgattcctctgcatgggttgttatagcagaggtagaaggagaatttaatccacagacagaagcagacgaatatatccagccgttacttgcagacaaaaaacagcttgaaaaattattagaaacagaaaaattttcaggaagagcgcaactgatggcgtattttttctgtaaaatacttagagaaaacaaacgaaaaaagaaataataccatatcccatctgctctgtagtcgctgtgtttaagatgcttatccgcatcttaaacacgctccgaagccgcatctgggatatggtattatttcttttttctgtgttttggcttcagaaggaatgaatgcaatagtctttggaaaagagaagggggagaaatcagaagactactgcttgctcggaagatgtatcatccagaagattatttgctctccttgatgagtagaaaaagtaaagaaatcgcctttatatttatcgtacattctaattcaagaatgccttggcattcttgctgtgaggtgtgcatcatataacgtatgacatacgttttgagaaaaatgatatattgcgacaatataatgatgaatttatcatgtacagtaatagcttgcgatatcatttttattatcagtgaaacttgaaaaaaggttcagcatagtgaaaatggcatcagaataagccgcaaccttctgtcaccttccccatctctttcccaaagactattgccttcattccttctagagccaaaacacagaaaataaaaataacagaccatcgcaaatgtaatgtaagaacaagtaaaaatgccgaacaggcattttctacgcagtgatatctttacagttgcgatggtctgttatttctattttcgtctgtttttcttcttaatgaatgaaatagtaaaaagcttttgttttaattcgcaatttgtgctatcatatgggctgtcattgaaaaggcatatgaagaagattttttcttcagaatgaggggaagaaaaacgaaaggttggaatgaattaagatgaataaattaagaaagaggaaggcaggaatcaggactttcttcaaggggaaacatggaagaaatttcttgctggcgctagatgttttactggcagttgccttttttgcaaagccggatttatattataatccggaagctccgaaattttttgaccgtttttatgcagattctctcattatctgtggcggtctgtgggttgctctggtttttctgactgtgaagaagattcatttttcagcagaagtaaataagattttgacgtatattgcagggatcgcaacaccatttatggcttttttatggttggaattttataacgatgcacagttttgggtgccgattttcagtattccatttttgtatctaatattagatattgttgtgtattatgtgatatatgttttatttttgctgctttttaatagcatacgaggagcttctatctgcatgattattgtgacagcagtgtttgggatttttaactatgaactgacattattccgaagcatgtcatttatcgcatcagatatttattcgtttgtgacggcagtttccgtagcaaatacctatcagttacaggttgatgttgacacagcggaattttttatgatggcacttgtgttggttgcacttctgttgaaacttgataaagagaagctttttaactggaagggacggattatttatactttagtatcctgtatgatttttgctggatttacacaagtatatgtgtacagtgattatctggagaatataggagtggattttcgtgtataccgcccgcagtataagtatcgttattatggaacattgcttacaacgatgcggacatttggttatctccatgtgacacaaccggaagattattcagtgagtgcagttaagaaaattacaaagcagtatacggatagtgaatctgctgaatctactgaatctaccgaaactaagaaaccgaatataattgcaattatgaatgaatcttttgcggatttaaaggaagtaggtgatctgcaggtttcacaggattacatgccatttttccgtaaattaaaggaaaatacaatcaagggatatacatattcttctgtatttggcggcaatacagctaactcggaatttgagtttatgacgggaaatacacttgcatttttaccggataactctgttccatatcagctttttcttagaagtaagacggcaggattgacacatacattaaaaaatcagggatacagtccatgctatgcgctgcatccattttataagacgggttacagcaggtataaagtatatccattaatgggatttgataaattttatacttctgataatttttcagtatttacagatacggtaaattaccatattacagattcagaagattataaaaagcttattagcctttatgagaatcgaaccgacaaagataagccattttatttatttaatgtaacgatgcagaatcatggaagttatgatggaagtactttagaaacaggggatgatgtacagattgaaggtgatctacagtcttattctaaagcagagcaatatctgaacatgattaaaatgtccgataatgcattaaaggaactcgttcattattttgaaaaagtagatgagccgactgttatcgtattttttggagatcatcagccggatttagaagaagatttttataataaacttttgcatacagatattcagaagttagaaggagaagagctggagaaactctataaagttccatttttaatttgggcgaactatgatattaaagaagaaaatgtggaacgtaccagtaacaactatctttcgacatatcttgcagaagtagcaggcattaaaaaaacaggttatcttgaatatttaacgaaactcagggaagaaattccggcaattaatgctatcggatattgggataaaaatggaaagttttacgaggtggatgataaaaaatctccatattatgaattgatacatcagtataatctgcttgaatataataatctctttggaaaagatgatcagcaaaaagaatttttttacataaaaaattaatatcttctacgctgcggctattttcgcattcatgaattttgtttggtagaatgattatgtttatgatataataagttaatatgcggattatatggcagaggagctgcttatcgcgtactaatccatcacaatagatagaaggagaaagaatagaaatgattattcgtttaaaggatggttctgaaaaagaatatgcacagccgatgtctgtgcttgatattgcaaaagatattagtgaaggtcttgcaagaaatgcatgtgcaggacaggtgaacggggagacagtagatcttcgtactatagtttccgaagatagtgatttaaatattcttacatttaatgatgatgaaggcaagcttgcatttagacatacagcgtctcatgtacttgcacaggcagtaaagcgtttgtatccagaggcaaagcttgcaattggaccggcaatcgaagaaggtttttattatgattttgatatggctccacttacaagagaagatttagatgccattgaaaaagaaatgaaaaaagtgattaaagagaatccttcaattgaaagatatgagcttccaagggaagaagcgatcactttcatgaaagaaaaagaggaaccttataaagtagaacttattgaagatttaccggaagatgcgacgatcagcttctataaacagggagattttacagacctttgtgctggtcctcatttaatgagtgtaaagccgattaaagcatttaaacttacagcttcttcaggagcttactggagaggtaacgagaataataagatgcttacacgtatttatggtacagcttatacaaagaaagcagatttagaggaacgtcttaaatatttagaagaaatcaagctgcgtgatcacaaccgtcttggacgtgatatggaattatttacaacagtggatgttattggacaaggactgccacttcttcttccaaagggagccaaaatcgttcagacattacagagatggattgaagatttagaggataatgaatggggttatgtaagaacaaagacaccattgatggcaaagagtgatctttataagatttccggacattgggatcattataaagatggaatgtttgtacttggtgatgaagaaaatgataaagaagtattagcgcttcgtccgatgacatgtccattccagtattattgttacaagaatactcagaaatcttatagagatcttccttatagaatgagtgagacatctacactgttccgtaatgaagattctggagaaatgcatggattaactcgtgtacgtcagtttactatttcagaaggacatttgattattcgtccagatcagacgaatgatgagttaaaaggatgtcttcacttggcacagtactgccttagtgttcttggtgtacaggatgatgtgacatatcgtctttctaaatgggatcctaataataaagaaaaatatttaggggatgatgaatactgggaaacaacgcaggatgcaatccgtaatattttaattgatcagggcgtgccttttgtagaagcagagggtgaagctgctttctacggaccaaagattgatatccaggctaagaatgtatatggcaaagaagatacgatgattacaattcagcttgactgtgctatcgcagagaactttgatatgtactacattgaccagaatggagataaacagcgtccatatgttattcacagaacatctatgggatgttatgaaagaacacttgcatggcttattgaaaaatatgcaggtaagttccctacatggctctgtccagagcaggtacgcgtacttccgatttccgagaagtttgccgattacgcagaagaagttaataaagaacttaagaaaaatggtatcttaagtacagtagataatcgttctgaaaagattggatacaagattcgtgaagcacgtcttcagaaacttccatatatgttagtagtaggtgcccaggaacaggaaacaggaaaggtatctgtaagaagtcgtttcgcaggagatgaaggtcagaaagatttaaaagactttatctctgcaatctgtgaagaaattcgtacaaaagagattcgtcaggaagtagagcagtaagaatacttgtgctctgatacagacgcctcatagaagataaataatccctatttgtgactttcgtcgcggcgtgttgaatgttcgctttagcgctcgcatccaacacttgctcccaggtcacaaatagggattatttatcttctatgaggctgtgctgtgataacttcaggtgatcaagtattcttttgaggagatttgaggttgcggtagaggtatcttctgtcaactacccacgacctaaaggttatgggcttgtaactgcccagtcgtactaacggattacacctccgacctttaatccccgatagatattgctatctaaagtggcgttacatcatagggtggctgacagcaccctttacagacaagacatgctcatctgtaactgtatcaggtactaaacttc

SEQ ID NO: 469 - DNA, 12399 bp, Eubacterium hallii
tttgcgttctggatccatttttcttcttcgtgccataaaaaatcctcctgaattgatatttattttaacatcaacccaagaggatatatagctcttttagagtttacacagaattaattacagtctcaattgttacattgaaataaaaaaataaaaaataaaaagacctctgcatgcccggtcatttaaatgacaggaaacatgcagaggtcttttatagtaattaacctgctaatctacgggaaactactttaaaatatggagactcataattatagtctttgttattcactctgagccagccagtctttttttcatattgaaactgaagatacatagtgtttttggacagagtaagctttttcaaagttacctgttttcctttaggaacagtgaaagcaagtttacttccgttataaaaacgtaactttttctctgttacaaaaatattttttcggaataatttactataagaatcattgtggtagttaccaataatacttttcacagtagaagtggtagtacttgttaaaacaagcttattattacgaaatttgtaattcattttccagttaagccatcctgtttcagcaggctggtcaccatgacgaagagtcagtaaattctttttagcagaaacaatttcgcaggctgtataatctaacttgcttacagaatagagctttttagatttgttattatatttataaatctgattaaatacaatataatcattatctccgatacccattagctgaagaagttcatttttatttgacattttagcatatcgggcagtaaaggaatgaatattgtcattcgtacagtttttagtaaaagcaactttattatttactttaactttcagtttttttatgaagcaatctttatccatactggttgtgataagaattttatctgcttttccatccccggtgatatcagcagataatattttctttacaggaatattcttcacagaggcagcattcagtatcatagaaaaaggcagacacatcataaatgcaagcgcaaatgggaaagtaactttaaataatttaaaaatagcatttttcatagcaatccctccttggaaaatattatataagaatactatagcatatttgcaggtaaaagttccttaattttcagatgaatttaattctcatgttacgcggattccaaagtcaaacaccttatcgtgcaagcacgaacgaagttttgatcttttgaccctaatatcatataaaaaaatcataaaaaatgatagtagccgacagtcacatttttataccaataaaaagaaagtgaaaaagaaaataaaaaagaacaatctacagatgcacaaagtatttttcttaaaataacagaaattattttaaggctactgtatacagtacatctgtcagatcgttctttttgtatatcagatgtgagaggattcccacatctgcaatcctgccggaggcattcttgaatttttgtttaggttagaattaaatgtttaataaatcactgtaggattttaatgctccatctgtatcatgagcaagaacacgttttgcgagaatcttaccaagctgtacaccttcctggtcaaagctgttaacattccataagaatccctggaacataatcttgttttcgaaatgagctaataatgcaccgagtgattctggtgttaactgttcaccaataataatgctggatggacgtccaccttcaaagtttttgttaaggttttcatcttttttaccacaggcgaaagcaacgatctgagcagctacattcgcacataacttctgctggcttgtgctgtcttcaattactacatccataccaatctggctgtttttaaaaccaacaaactgtaaaggtacgatatcagttccctgatgtaataactgatagaaagaatgctgtccgtttgttcctggctcaccaaagatagtaggacctgttacataatttacaggttcaccaaaacgattcacagacttaccattggattccatatcacactgctgtaaatgtgcagggaagcgacttaatgcctgagaatatggtaaaacagcagtagaagggtattcctgaacattacgttcataaacaccaattaaagcatctaacatatctgggttttctaaaatgtttttattagcagcaagtttatcttcttcagctgcaccatttaaaattcttgcgaagatttcaggaccaaatgcaagggaaagaacaactccaccaactgcagaagaagaggagtaacgtccaccgataaagtcatccatgaagaatgcttctaagtaatcatcgctctttgctaaaggagatgtctcacttgttacagcaagcatatgatttgcaggatttaatccagcctttgttaaagcatcttttacgaaagcttcatttgtcaatgtttccaaagttgttccggatttagatacaacgatgaaaagagcatgagctaaatctgtagattttaaaactgcagcagcatcatcaggatctacgttgctgataaacttcgcttccatcttagcaacaccgttttctttagcccagttctctaatgcgatatataaagcacgaggacctaagtcacttccaccgataccaatctgaacaacagttgtgaacttctcaccagcagcgttagtaatttcaccggcatgcactttattagcaaaatctgcggctttctgctgctgggaaacatagaaatcacgcttgtttacaccgtcaacaacaacatctgtacctaactgtctacgtgctaaatgatgaagaacaagacgtttttcaccggtattgatcacagcaccgttatataattcttcaaatttatcagcgagctgtgattcttctgctaattctgccagcgcagccaaaacagtgtcatctacctgctttgcagcatagttaaagctaagtccctctgccataggtgcggaatattttgctacacgtgtagcaccattctctccgctcatagcttctttaatgtctacgtggtttttcagtccggcaagtttcttataagatgccagagtgtcaagattgttccaagttgccataaataaatcctccttagttaatgtggttatacattaagcttaaataaaattaagaatgcaaaatataataatgcattcaaaatttcttaacataattatactaaaaaaaatttccaattgcaatggattatttactatttaattcattagagaaaacaatcgaaaaaagaaatactaccatatcccatctgctctgtagtcgctgtgcctaagatgctcatccgcatcttaaacacgctccgaagccgcatctgggatacggtagtatttcttttttctgtgtgttggctccagaaggaatgaatgcaatagtctttgggaggaataagggggagaggtcagaagactactgcttactcggaagatgtatcatccagaagattaggtactctttttaacgaacagtaaaaataaagggggttgtcattttacaaaaaagtacagaaatcgcctttatgtttatcgtacattctaattcaagaacgccgcggcattcttgctgcgagatgtacgttatatataacgtatagcatacgtttcgagaaaaaatgatatattgcgacaatataatgataaaattattatgtacagtgataggtttcggtatcatcttatcatcagtgaaacttgaaagaaggttcagcatagtggaaatagcatcagaataagccacgaccttctgtccccttccccatctctttcccaaagactattgcattcattccttctggagccaaaacacagaaaataaaaagaatagaccataacaaatgtaatgtgagaacaagtaaaaatgccgaacaggcattttctacgcagtgatatctttacatttgttatggtctattctttttattttcgtctgttttctctcaatgaattaaatagttatttgcaaaatatccattttgtgttatcagaatattcttctttatatttatacccaagttcatcaaattgtttcatttcctctggattttcaatctgatgctctgccatataacgtacaagggaacctcttgccatctttgcataagttcctttttcttttattttcccatcaattatttctccgaatacacaggttatgacctgtacattttttggaatatatttcaaaacacttttactatattcttttgaggcaaggttaatgagacaatcacagtcttttaatatatagtctgctaatttttgtccccaaaagtcgtataaattatttattttttcattatgaaaacgtgcctgcatttctagtcgatacggaatcaccccgtcaaacggacatagtacaccgtaaaagccggataaaatcctcaaatgcttttctaaccatataaaagcctgttcttcaaatactgctggtgccatgtatttatactgaattccctcataagaaagaatcgccggacttagattttgttttaagtttcctgttcgaagctgttgctcattttcctgtacaagcttgtcactgcatttccatagattttttaattcctccaaagacatatttttcatataagaaaaaagagtttgagccccatttataaaaaatggtatatttttgtaggataaaatgtcatttcttacattcattttttttgccggggaaataattatttttaacatgggtagtttcctcatactttctgatcatttatctaaagaaactatactatatatttgccaaaattactatggattcatttagaataatatacgaccgtttgtaaactattgaatacaatccttttggagccaacaaacagaaaataaaaagaatagaccataggaaaagaaatgcgagagcagataaatgtaatcttctgacagagatacctttcgagcaagcagtagtcttctagttttcccccccccttctccctccaacaactattgaatacattccttctggagccaacaaacagaaaataaaaagaatagaccattggaaatgtaatgtgagagcaagtaaaaatgccgaacaggtattttctacgcagcgatatctttacatttccaatggtctattctttttattttcgtctgttctctctcaatgaattaaatagaaagaaaatagtgggagaataaagcagctaagacggctccgacaaatggagcgatgccaggtacgagcaggccgtactgccagtcattgtccgctttatttttaataggaagtaactggaatgcaagacgaggacctaagtctcttgcctgattcatagcaaatccggttgttccgccaagtcccataccaacggcccagacaatcagtccaacaccgataggaagctgtttttcgtaatttgttgcgacagccaggatagcagtcagaaaaacagcagttgcgattgtctcgactaggaagttacgtggaagatttctacagtttggatttgtagaaaaaatgtttcgaatagcaatcgggtctatttttccttcacttgctttaaaatggtcggcatacataacataaacaacgagtgcgccaaataaagcaccaagaaactcagcaatacaataaggaataaagctgctccaaggaatcatgccaagaattgcctgacataatgccatggcagggttaatgcagacaccaccaaagataaacagggaaacagaaataccaaaagcccaggtggtgatggcaaaaatgtgtccgcttccatggtattttgttttggcaaggacctcatcacagtgtacgccgacaccgaataaaatcataagagctgttcctagaaattcagctataagtgagtgtaacataacgattttttcctttcttctctttcgttttataaaattatttatagcattttaataaaaaagtttgaaataatctattttgataatgatagtcgctgaggatactaatattaaaatttagatattaacaacaacgcctaaaccatcaggaataacagcaacttttgcatcatttcctttgattttaaatgccatagcaagagcttcatctacattagaagcaagttccatatgcatatcttttacgagttttgggtcaacaagatcagataccataataaccttatggtgtgccaggatacgggcaaaaatctgtgaagtccactgatctggtacagtttccagacgaggagtatggattgctttttgctcaaattcttctggatcttttacatcagcaatgttatggtagaaaccaactccgccatgaccatcgcggcatccggcgatcataataatgattccatcatcaggaagagtagcttctgcagcagtcatacctttgatagcctgataaatgttctggtcaagaggataaccgccgttagtggaaatagcgatatcacaatttactttgtttacgcttgcaagagaacgaacaaaatcacagcctttttcatgagcagtttccatatctccggcaaaagaaccaataatctcgtgatttccatttaatacaacattaacgataaaagcaagattggctgttcttgcagcataaaccatatcttcgtgaattaaattatgacagagattacccgggcgggattttttgtcattaataaattctccgctgtgattagccataattgttttataggaagcaatacctggtaaaacagactttcttccaccagaaaaacctgcaaaaaagtgagcttcgataaaaccttcagaaatcaacaggtcagcttctgctgcaattttattaataatgcagtcaccgccacttggcagaacaccaatctttttcatagaagcatcatccgtagaaatatgcataacaatttcttcattagcaacgatttcttcgccgtatttatcaactaattcctcatgggtactaggacgatggaaaccagttgcaacaagaatacggattcgtgcatcaggggatacagaacggattcttcttaaaagaatcggagtaataatttttgatggaacaggacgtgtatgatcagaactgataatgacgatatccttttttccttttgccagttcctccaatgatttcgaaccgattgggttgtctaaagactgctctaccagttctttctcagaaagtttggtggtgtactcagactgttttccttccaaaacacctgcaagatttttctcagacaggctgattttcatttctcctttatcgtaaggcacgttcatttcaaacattttaaaatcctccttaaaaacttagatatatgcgagtacattttcttaacaggaagttattttatgcaaaataaatgtctctgcaaaccacatttcgtgttaataaattgtgataacgaaaaatgttatcaaatgttactaacatctgttaaaaatatgatatacttttgtaagaagaaaggatgaaaaaaatggaacatgaatatttgctagagtatttagagaaaaaagacattccgatagtacataaggcgcgccatacatatcttacttattatggttttgagcagcaaagtacttatgtattaaaagaaggtgtagtgaaaacaagtattatcctaagagatggaagagagtttaacatttcctacttaaaggctcctaatatcatttcattattaaaagacgaagtaagccaatatacttctgcaccatttaatgtaagagtagaaagtgaatcagccgtattttacaaaattcctcgtgtaactttctgggaatacgttaataaagataaaaaacttcaagattatattaatgtctactacagagaagaactttcacaggcaatcttatcgtcagcagcttatgacaatgaatggaaaaacaggagcagtatgtgcgttcctgtacttgcagattgaaccatttggaaagaaaatgaaagagggaattcttattgattttcagattaccaacgatgatattgcaggattttgtggaatatctacacgaaatagtgtcaaccgtattttgcgtagattaagagagaatggagtcatctcagtagaaaatcagaaaatactcataaaagacaaagaataccttgaacaatatatgcaaggataacctttaatttgtagatttagtatagacgaaacaaggaaaaatgccatatcccatctgctctgtagtcgctgtgtttaaaatgctcgtctgcatcttaaacgcgctccgaagccgcatctgggatatagcattttcccttttttctgactattatctaaatctaaagttggtgagaataggaattctccagaaggatatgattttctaagtttgattttattgtgctacacgaaactctttgtttttgaggcaaaattccgcagtgcaaagtcacacaatgcaatacttataaaacttccatttttgttagaatttccttataattcggcaggaaattctattatagcgagtgcctaacctaatcctacaaaatcagttaactatggatttagattagacagaaaaaagaaaaaacaatatatcccagatgcgtcttcggagcgtatttaagatgcggataagcattttaaatacagcgactacagagcagatgggatatattgttttttcttttttcgtctgtattaaatctagaaatcagacttatttagctgtggcagtttctttatgagctgctttcattttatcatactgagcgaagagtcctgccagtaatgtaccggaaatggaatgccatacacaggaaacagcgcagataattgcggattctggtgtagaagcaaactgtgcagttgttgttgcaaggtttgttgcaagaccggcattctgcataccaacttcgatagagattgttcttttctttgcagtattcattccagtaaggcgaccggcacaatatccgaagaaatatccgagaccgttgtgaagaagaactgcaacgaagattacgactccagactggaagaattttgaaccctgggaagagataactccaccaacaacgcaggcaagaccaagaacagcaacgcctggcataactttttgtacttctttaaatgttttatttttacctaatgcataatttaatacaaaaccaattgctacaggtacgataacggtttcaatgatagaaataaacattggaagtccatgaatcgtaatttttgccccacttgcaagaagtgaaaccatgagtggtgtcataactggggagagaatagtagatactgtcgtcattccaacagaaaaagcaacatctccgccacaaagataagacatgatattggaagatactccaccaggacagcagcctacaagaatcagtccaagtgcgattccagcaggaaggtgtagtaattttgtaataaaaaatgctaaaaacggcataattaaatattgtgcaatggctccgatacagatgtcaaatggtctttgtgccagaatcttaaaatcatcagttgtaagagtaagtcccatactaaacatgataacaccaatgataatagactgacttgtaaatttattagctaccgggtcagtgaataattggaaattaacccagcccatcaatgatggaaggaaaaatgtgattactgcgatggcgattacaacgatagatgtgtaatctgataaaaatttgctgaatttttgtaattgtttcatacttatgttacctcctgatgttcctcaccgcttttgatattattcgttgtattaccaagaaaacaaaaaatcccttctcagaaaaaactgaaaagggacgaaaaaaatccgcgttaccacccaaattctgtaataaaattacagctcttaacgtactatcatacgctttccttttaacggaggattccggcgagacttactgattaaaaatttaagtaatgttcagtccgcatcttagagaggatatctgtcattgaaagtgtacctgctcacaccaaacgcaggctctctgaaacgccttattcaaaaacagcattgttctcttcaacgaatttcggtgaagtttatgtatttgatgaacctcattatagtccgattttttgaaatgtcaagagaaaaattgtcttaaatttaatacagaagcatattttgaggtaaaactaattttgaaggatacagtggtgcaccttgtcataatagcttataaagcgtataataaataaaaaaatatgcagtttttaatgaggtgctttgcaaaaaaataaaggagagatactattatgtttaacatttttaattcggagagtctttggattggaacagacatggagatgtttaataaaatacgtacaaggttagaacaagaaggaattccctataaatataaaacaaaaaaccatttatcacagacgatgttttcggcagaaggaacattaagaagtcgaatgggaagcttgggaaatgatgtgaatcaaatgatagaatatgagatcttggtacataaaaaagattatgaaaaagcaaaaaaatactaatttatagattgcgtatagacgaaaaaagaaataatatcatatcccatctgctctgtagtcgctgtgtttaaaatgcttatctgcatcttaaacatgctccgaagccgcatctggaatatggtattatttcttttttctgttctttggctccagatggaaattagtatttggattcgagaattcccttctctttccaatataaatcgttaatttgttatttgttattaaactgtcagccgctaaaataaaatttcctgctgaattgtaagaaaactatggtaaagaacaaagaattgttataagtattgtattttgcgactttgcgctgtggaattttgactttgaaaacttcggactcatttttccgaagttttcgttttttgaggcaaaatgaagcgtttagcgcaacggaacaaaatcaaacttataacaattctttgttttttagaagactgaatacaattcagcgcaatatcttctattaaagcagtgtctgtgtcctcagcaaattagtatttaatcccccatcttcatcaactgtggatttggaatagtcagaaaaaagaaatactgccctatcccagatgcggcttcggagcgtgtttaagatgcgagcgagcattttaaacacagcgactacagagcagatgggatagggcagtatttcttttttcgtctatatgaaatctacaaagctggcccacaggtatctcgtatagtgagtctgcaaggaagtgtcattcttacaggcatattgtaagctaatttggtattgctttctgcgagaagctggatatagtgggcagcaaattgtcccataaaatccgcaggagcatagatcgttgtcaatggtgggttggagaactttgctacattaatgtcgtcaaatcctatgacggagatatcttctggaatacgatatcctttttgataaagagcacgcattgcgccaatggcaataggatcactggcagcaaagacagcactaggaagagttcctgcatcaataagctccatcatcatctggtatcctgcatcagcagaaaattcagtttcttttaagtaaggttcataagtaatatgatgttctttgcaatagcggataaaggtatcttttctttgctcaaaatagacagtatcatcgtttaaatattcttttccgccaagataagcgatggaagtatgtccaagatcggaaagataatcaagggcatcaataacggcctgctcaaaatcgagagatatcgtattacaattgatttttgaggtctgcatatctacaaaaatgacattgggggtgatagattcaaaaagttgaatctgttcagcattaaacttaccgatacagataagtccctgaacatcgtggagggcattgatataatcgggatcactttgaaaagcacgtcgaatttcgagattctctgtcatacagtatcgctcaatgccacttcgtattgcctgataataaggatcttctagttcttgaaataaagtaacccattggaagatgccgattactgtttttgaagaaggtgcagtcttttttttataatttaattcttgggcgatttctagtacgcgttctcttgtcttggtagtgacactcaaggtttcatcttgattcagaatacgagatacggtagcagaagacacgccggctttttttgcaatatctttcagtgttgccataagaatagcactccttttcgtgtgtttatctcagtcgagaagactcccacatctttcaggtggtgagtgacagcaaatttgtctcagtgggaatccaatctccgactgagataaacgctccgcgaggatgcgcagtgattctgtaaagaatatgtcagcttacgctgaccagaatcacgcgccaagtctcgcggctgctcgacttgaatatattaagtattaaggta

SEQ ID NO: 470 - DNA, 11970 bp, Eubacterium hallii
aggatattctttgttttctatcaggatacggatccgtttttctgcttctttccatgtcagtttcttttctgcctttcctttttttaaatgaaatcctttggcatcatgccactcatcagaatgggaacttcctgatatagaatgggaatgtcctccgataccatactcttcttttaggaaagcgatcgctgcttttttgtctggcataggttcctgctgataaaaagacaggatgcgtcttttccctccctggacgatacctcctccctgcagtagtctgtcgatctcatcttctgtgataaacgctgtctgttgtggttcttctccttcctgtgggataaatgccgatgcattttctaatttatgaagtttgtctgttatattcttatatcttttttgctgccattgggtcttcagatttacatccgttccatatggcaggatttcctgatagatattctttatgttttccggctcttttaactctccggcaatctgctcgacagcttcactgtaaaccactccccaccgggattgtttcatctcttctctgtaaaaaaagcagaggagacttgcggtttcctttcgtacaacatctattgcctgccctgcgaatgtatttgtagtaaacttccccttcttataaagtgtttcgatccgttctgcggcttcgtcccacgataatatcttttctggattccttcttgcaccattcccccggcgaaaaaagatcccttcctcactgtaccatacactgacttttactccgtctggcataaaaagaccctttccgcctttccatgcctctttcaggtcttttctaagcagttctcctgattttttctgcatcaggtcaagtagcacatattctaaagaatggtcatcattcccgcctgtccgtaaagcttcgtcgatataagtttccgggaacgcaaaaacagcaaccggtgtatcacctgctgctgttccataatcagcttgttcttgttcattttgtggaaataagcttaattgaatataatctcctgtttcactatttcctccgcctgctgtttgcagttgtttaccagacctacccatttcatttgatcttttgctttcagattttccgttgctcctgccgccttcatcagttctggcatcaactcgtccattctctcgtccgcccgtctctgcacttcgatcagatgtccctcgtaatccctcatcagcagaatctgatacgttgatttgtcgtgttccttcagatacttttctctcatcagtccgtatttcccgatgtgcccctccgtctttgttagtcccagctctggatacatcagaccgtcttcgcctttcgtataggttaatttcatcttgttccgcctccttttgtactggtatctgtctatcttgattatattcttttgcccttcctcctacaatagtttctgcccggtttttttgtaaatttttctgaaagagataaagtccgatctctttcagtattgatgcacaatgctcgcttatcggagatcccaaccgcagcagcacctcctcattattaaaatctgtgatcgaccgaaaatcctccagatacatatattctccaggatctatcccacaacggcttaacagcagataccatgccgtagataagaacagttccctgtactctagccgtatcgtatcttggtctaaatcctctaaataagaatcctgcctgtccctcagcagttttggcacttcttctgccatcgtgtcttctatgatctcttctgttaacttttttaacatggtagcaaggtctgcctcttgtcctttgatatggtatctcctttgcagatgatcggacacatcttttttatcctcctcgtctatctgccagaggtatggcttccttacttctgtaacagggactcccctcacaataccggtatctttataatcatacacataccttagttttttccgtccatttaccgtatgtatcagtgcgatccctgctgtcccctgctttacataatggtttgttttcttccatgtctggaaactcgtgcaccctaccgcattcggacgctgtgcgtagatcataagctggtcatcaaaactatactgatagacgcgagatgctgtgtttaaaaaacgcagccattcatcaggtgatgaagatacttttctaattgtttcttcaaacatttcctcggctgttagtaatgttgttgccatctgtaatttctcccttcttttattttataaatctttattttttcaagtaagttttcttatggaggtccacgcatcataatattcacccttctttctatatcaaaattggtaattctggaaattaaaatggcaggtatatacaaattttatgttgcaacatctactaacccatccattttgtaccgaatttcagtacaaaaaaagcagaaaggatacgcctttctgcttttctacatctaacatactttaaattttaattctttattactatattttctattaactatccttcataattctctgatgcattatacataatctccatatttttaagtgcatctttccgcaatcaattgacataatgcagctctttgatattctcttgtaagttcctttactttattattccatttttttacaactggactatatgataatgcaattgcacctattatcattgccactggtacataataattctctgcaaattttaaagcacatactactggtaaaaaaggaacagattgagcaatatcatatttcaaaatttttcgtttgtaattattaacatctatttccttccatatttttgtatcttttagttcattcttccaaaactcccagtctggatctggcatttgtggatgatagatttgaaaaatcgcttctacctcaggtgtatactctatggtattatatctctcctcaaatttcctatctgattctggtttcttagaaaaatacaataatttctcatttttatcaattgaatatttatagttatcataacaaactccacaatatggaaattcactccatttatgttttttataaaaaataactcttcgaaatgtaaccccctctgttgataaaatataatcatcgttccaaaataggaaaataagaagaaggcctactgacacatataatataaattcgctccaatctatacctgtccttgaaaaattttctgctactgtttctctggtaagaccatactaaaaagcaaatataactccggtaaatgcggatactgatccctcaatttttctagaatatattacttgaaatttcatttcatcctcacttaatatatatactcttaaatcaaagatttaatttaagtacatatcaatgtcaataactgcatccaaataatttacaatatttagaaaccttttctcaaaataaattgccggcaagttatctttctcaaaaattggaactatctcaaaacaaacttctccattattttctttacatatctctttaattatttccaattttccttccaacttccttaacaaatcatcaattaccggttttatatctaattcttcaaaagtgtctgtaaccaatgaccagtatccctctaaatgcttatttttattaaatggtgacattctagtttcattttttcttttacaatctgaaggttttatatttaatatcctttcaattttatatacatcaaaattattatcaaaaaataaattcatttctatatatatacccattttttacaataatcctttctttatacacgatatattacttaatataatacaaaatcattctgtttctttcttaatatataaaagtagactagataatgatttcagcaaaatatacttcactcaactttcccacaagtaaaacaggcataaacctaacataccttaaattttaatgctttattactatattttctattaaccatccttcataattctctgatgcattatacataatctccatatttttaagtgcatctttccgcaatcaattgacataatgcagctctctgatattctcttgtaagttcctttactttattatgccatttttttataaatggactatatgtaaatgcaattgcacctaccaacatcactactggaacataataattacttgcaagttttaaagcacatattattggtaaaaaatgaacagactggataaaatcgtatttaaaaatttttcgtttgtaattatcaatatctgcgtcttcccacatttttgtacccattagctcgtttttccaaaactcccagtctagatctggcatttgtggacaataaatttggaaaattgcctcaatctcaggtgtatactctatgacatgatacactttctcgaatttactatctgactctggtttatttgaaaagtacaataatttttcatttctatcatctgcattttcattttttttataacaaattccacaataagggaattcattccatttatgttttttacaaaaaataacttttcgaaaagtaatgctctcatctgatagaatataatcatcatcccaaaccagaaaaatcagaaggatactgaatactacatttagcgcaaattcgctccaacatataccagttctcgaaaaattttctgttactgtttctcttgtaagtccatactgacaagcaaacataaatgctgtaaataacattactgccccttgaatttttctagaatatattacttgaaactccatttcatcctctcttaaaatatacactcttaaattaaagatttaatttaaatattttacagtatttgtttacctatgcctctctcatttcataaaccccatcatcggtcaatatcaaaactccttttgtcggtatgtaaagaatatcataaacatatttatctagacgattccttttaattatattctcagcatataattctgtaatgcataaataaccatgttcatctacataaatcattcgattgtcttgttcagaaatctggagttcacgattataccaccattctccttgtttccatctgttatttacaggaatgttcagtaaatgtccatcagaacaatataaaaggctatctccttctactctttttttacttgatgttgccacaataaccttttttttatttacatcttctataataaagcaaattttacaataatcttcttcttgctttctatattgatatttaagctctccatctttttcaattcgatagctatatcttatcactttttctcgttgcttatatatattttttgtcttggggcttgtaaatacaagaatattgtttttatcttgtactatatgtgtgacattctcaccttttatttttactacaagttctacttctcctgttcgtgtatttaatcgatatattcctttcctaaaagatggataccaacaaaaatccccttcccatataatctgctctgaccatatatctgactgttttaaatatattttgggtaaaaggcgttttccatcaggtaactgatataaatatgcatatcctgatgtattataaaccaataatttctttgtttcctgattatatatagactgagacatattcgataatttatcggacacaaatacttcttttccagtgttacacgatacaacatttatcgttttttctgctgtaagtcctatatagtttttactcagtctttttatagaatgaaattctttttgtgaaatcttttccattaaaatattccccttctcacaaaatattaattttttacctttagaatactctagataatagttttctttttttcattagctttcctcttatatttctttatttttttccaacaacacttggagttgtgccagttgctttatcatttcctgctgtaactgtgtatttcatacggtatgtagcaccagttgtactgttataaactgccttagaatttaccactttagtattgctatatgatttattccagctttttaccgtattccaagaacttccatttttcttttgaagactcattttgacgcttattaagattgatgttttcatcaatacatcaacactacaatttatttttcccgatactgcttggatattaccacttatttggctgatatttccataccgtggcataatctgttctactgctacattagtatgtacatttttttctgctgctattaccgaaaacggtatactaactaatgaaacagcacatatcaacaacaccataatcttttttctcataaaaaatcctcctttaattgtgtctatataagacacaatcgaaggaggataagtgtgacattttattttatattttttaatatttttattaattctaattctttttctgtgctggacagcgtaataatgcatccattgtcttcataatagaacgatgtaatctctttatctttaacaacataaatctcttttccattcacttgaatttttctactcccagttccatcataagtaacatgaacatcaacattttcctttaatccctgtgtaaaaccgatataattatcgttttgaccttcataataagcactatacatcgttataggattttctgtttcatacagtaaattgtaatctgctggtatataagtcagatgtagttgtcgaaatattttttcggattctgtttgttcttcagaattatgtatgtaaatactatcctcaaagaaatgaatgataagtgttccaactttttctcttaaatcatcatttgccaaaacaatacctgcattcaatatcaaaataactgctgctaccagtaaaaaacgtaatcttctttttttctttgcctttcttttttcttcataaatcattttattcattttttggataaattctttagaaaatttataagaataatttttcgtcttttctgttacttcttcatagtcttgcagtgccgctctctgagcttcctgttctaatagtttttcaaaattcataggtgtatccttttttcaacatacctttctttaactgttctttcgcacgactggatatttttcttacatttgcagaatttgtttccaaaatctctgcaatctgacggctatttaatttattgtgatattgaagataaataacttctttataaggatatttcagtcctctgattaatgaatttaagaattcttctgattctttcttaattaactgactttctagcagattatgcccttccacagactgttcaaaaattgtatcatctgcaattaattcaattttcttacttctctttataaaattgtaacatttattctttaatatagtggcaatataattccatgttccagtgaaatcttcttcatcaattctatccagataatccgttaaagtaagaaaagtatcatgaaccatatcttctgcatttaatttatcttttaaaataacacttgctgtataatgcattctatctttgtaagcatcataaattttaacaaattttattttctcctcctctgtatccaataccattaaataaataaacatattcataatctcctaattattttttattattttatcataaatatgatttttttattatgtcttttattataaatgataatttttttgttttttcttcggttttattaaagaaaggttctcttttatctcaaaatgtttttctaaatatcttactgctttcctgacctgtctgttttctttataaaacggtactgcatctaacatctccttacagatgtgccctccggcgagcaggtcacatttatcagaatacatatgcccttctggaaaatgcaggttgataccgatcgcttttataccgttttttctgtctcctggtattttttcataaacagcgatcgcttcatcaatggttaaaccctcgtgatattcacccaatgatggaaattctgaacattctgcaacataaaaatcaacttctggtattggttcaggttccttatcaaaaatagataatctttcaagcttttccatttggatcagcaggtcttttgcctgttttatatcctcctgatctcctgatatttctatagtttttttaagataatcattcagatagcccgtttttttctgcaggatgtcatctgtgatcgcatccactgctttctccggctccatcgtttcatctacataccaatctccccgtaaacgtccgaaagtatctatctgttctgcaaactgttcaatttccttttcatccagataatactctgccctttccagatattcaggcaaagttcccgatttcgtttttgatataggattaatgtctatcggaatctctttaacatataacatatcttctttcagatagttaaaaaaactatcttcgctgattggtccctgataactaagggcaacatccacatctgaatctgggcggtataagccttctctgcttcgtgaaccatacaccctcgcaccgatcagctctacttcattatgcagacccagttcatctactatgatctgtgcctgggataagacggtctcttcaatatccgcccggctccttccttctaacgatttttctttgtaatatacttcggaagtaagccgaatatcccctccttttaattgtctctttgactcctgtactgcataatgtaataattctttctcttcactttcttcgatattctgttccagttgctcataaccgatttcttctatagttgcaatagctatcccagcatcatttaaaatatcttctatagcctcggctaatgacacatctggattatcataaactcctccatctaattcccgataatcctcattataaaacgtataatcatatcctccatccgtttcatggatcataaaatatccgctgtctcctgatatgacataggctgcttcttttttttcatgaagcgatctgtttagtaaatattctccaatcaatttcattgcttcaggactaaagccatgccatagatcttctgcaataacctgtccttgttcatttacgataatatctgcaaccttttctccaaattcatcatgccgcatctgaaaaaatttttcattgtgaaattcttgcatttgtatcgaatgccatgtcccgaagtgtccctcggctgtaaatccctgtgttgcttcagttatctgccctcctactcttagtgccggctctttataaaaatctgataatgggacaaaccctatcatatctacataagaaacatttatttttccatttttctttaaaacaataatatcgctgacggaaagggaatgtcctgtgaaatcctgtgggtgtgcaatattaaattttatatataggctgtccatgttttcatctggctctaagattccactataaacaagctggtaatctttcctttgcggcagctttccctttgccctgatggaatcataggaaaggaaggcatactcccttccttctcccttccagtcgatctgatagatcccataagcatcctctttcccatgcaggatctcttcttcacttaagttaatgcctgtctgttctttttttctcatggtcgttctctccttttcttcctcacctgacgtaatcgctgcatcattgccggagtaaggctggcagatgcataagttttcatctcctgtacactatccccctcttccagacattggatcaggaattctttttgtgcatcattaaaggtatcttctgccagataagtctctataaattcattattgttatcttgaatccccctcttcttgttttctttacagaaaaaacgccagcgtttcttttttctctctatattgtttaccggagcttcctctataaagacggcttcttttttctcctcttctttaaccgcagttttcttctcctctaatttcaaaagaagatcttttttctcattctcccatactgccttgttttgttctatctcgcttaacaggctctgtatcttatcttcccggtcttttagcagctctgctttggaagctaaggtactctgatatgattctttttgctgcacaagagcttcttcctgaatctttaatgtctgctttaatgttgtatttattgtatcccttaattcttctgtttccttaaatactctgcccgctttttcatgtaacttagagatttgctgtgtcacctgtgcatctggcacaaataatctttcaagataacccgtccgttcttctctgatacgtttgatcttatctttccagttctgtacagggacactgtctattctccgcacttcttctatcggcattccgtctaaaaaacaaaagcagtaatattcacaaaacacttcatcttctatctcatccaaaaaagctatcacctccgcactgcatccggcttcctgcagtatctttttttgaaattctataacaatatgtttttcttcttttgatcccatttattttttcacctcctgtgctgaatttcagtacgtccttttttctttgtaatcttttcttctttattcaagcttttttcttcttcgatcatccggtttacgatccgtttctcatgccgcacctcacgcagcatcgcattgatctgtcttttttccttctctgcactgagcatcccttccggcatctcttttaaaaaatcatttagttcttcctgatatatttcaaactggtcatcccaatcgggagtatcggccaatcgtttttttaatacccggtactgctggaatatttttttatcttcgacggaaaaaagagtccttcgctgattgaaaagctctgcttctttctttatcaatatcttttgtttttccagcagatctttttctgttttgatctcatgccctaagatatatttacactcttcatagagttgatcaatatggaccgcatttctcctcacttctttccatgctactgcataaggatttttttcttcaagataatgtcctgtctgataaaagtttttaatttttttcatctgaaatactgtgagcgttgttttggtatactggaagatctctctttcataaacttttgacagttcatgggacaggatcttttctaccccctgttcctgtcctttattttttatcctttccttgatctcctctgcccggtatcctggcccaagccgggaatctctccgtccccgttcaaaaccaggcgggatatatgtcacatattttttctgacggatcttatagccaagcccttccatttgccttatgaaatcatcccaatcttttgatgaagcaatcacaaaatctatgtctgccttgataattttttcggatgatggcctgccttctttctccgcataatgtgcggcataagattttcctatcttattgtttttgtcataagccaaaggcggcaggccgtatttttcacagatgcggtctgtgagaggctgaatatatttttcccagtctttcttttcataacggtatttatatccactcatccggttcacagaattaaagacaatatggccatgcatatgtttctgatccgtatggatagaaaaaacatagtcataatcttctcccagatattcttcacaaaaatcatttatcaccgcataggcttcttcttttgttgcttctcctggtggaaaagagatcacaaaatggtatccctgtcttcctccttccttttcccattcctgttttgtatcaatcattacctgatacacttcctgcggggtcgtcccggcatttcccccgaccatcccttctgttttatctgggttcatgatgtaagaaatacaattttttaaatgtgcagccccgcctccctttggcattccaatatttgatagcttagtgattgccataatcttctaccttctcattaagcgttttcatctcatgctttacctgctctaatgctttttcaagattataaatatcaatctgattgccataaccagcattaatttttgcaacgacctgattgatattgactcctattttacgcacttggtaggaaagattctttaactctttttccaatcggacagga

SEQ ID NO: 471 - DNA, 11895 bp, Eubacterium hallii
cttgatcatattttcataagcatcttttccaaaataatagctgtgtgctttttctccatgaacgataaggactgcacttctgatttcattactgtactttaatattggctgattcataaatgacatacatccaatactgttccagccatcatttgaattcaggctccttttatgataacatctgcctttataatactcactgtaatcttttacgaagaaaggtgtatcttccggaaccggaaggggaacacaaccaccgcctcttgaatattcgcctttacggtattcttctgtcctgagggtattcagtgactgtttctttgcataacgtgcttcttcactgtcctcagaatcaaagtatccattcgcatttacccttgtcatatcatacatggtagatgcaaccgttgcttttattcttgtatccagcgcagctgcgttaagagccattccaccccagccacagattccaatgattcctattttatctggatccacatcttcctgaacagaaagaaaatctacagcagccataaaatcttctgtattaatatccggtgaagccatatatcttggatttccaccactttcccccgtaaaagaaggatcaaatgcaatcgttaaatatcctttttcagccatcgtctgcgcatataatccggaacactgttctttgactgcaccaaatggtccgcttacggcaattgcaggatatttcctagatacatttttcggcttatacagatctgcggcaagcgtgattccataacgatttacaaatgtcactttcttatggtctactttttcactctgtggaaaagttttatcccattcagataccagctgtaattcttctgtttttaacatatttaacatcctccatatgcaaaatttcttgtaattacactaataatagtatatgatataaatatcatacaacctaaagttagctttaggtcaagcataattttgaaagaaggttttttatgtatacaatcggtcaggtctctgcaatgtttggtcttcctgtttctaccttaaggtattatgacaaggagggctttttccctaatctgaaacgcaagggaaatatccgttatttcagcgataatgaattagaagcgcttcgtattattgaatgcctgaagaaatcaaggcttgagatcaaagatataaagcaattttttagctgggtatctgaaggcggctccagctataaaaaaaggaaagaattatttgaatccagaaaatcagctgttgaaactgaaatccaggaacttcaaaaaactctctccctcttaaaattcaagtgctggtattatgaaacagcaatgaaagatggtaacgaagatgctataaatgccatgttacctgacaagcttccagaaaatatacaaaaactatataacaaaggacatgaatgatttttgttttcttcatcaaatacataatttaacatgaaagtcaataagcatttgaaacaacatacaacaacttgaatgtcaatcctttaaaattcaatttcccggaaagtcatatccttctggtacattccacgttgccaactgtagatttagatagccagaaaaaagaaaaaataatacatcccagatgcggcttcggagcagatgggatgtattatttttttcttttttcgtctacaccaaatctacaaatcagtatctattggaataatggtgttgagtaatatctatcgccgttatctggaagaagtactacgattgtctttccttcattctccggacgttttgcaacttctacggctgcatataacgccgctcctgaggaaatacctgtaataataccttctgctttggcaagttctttcccgtattcaaatgctttttcattctctacagggaaaacttcatcataaatctttgtatttaatacatctggaacgaatcctgcaccgattccctgaatcttatgtgcgccgccatgtccctgtgataatacaggagaggttgctggctcgattgcgatgactttcacatctggattctgttcttttaagtattctccgataccagttactgttccgccagtaccaacaccggctaagaagatgtctaccttaccctctgtgtcattccagatttctggtccagtggttgccttatgtgtcgcaggattcgccggatttacaaactgtccaggaataaagcttccaggaatctctttggaaagctcctctgcttttgcgattgctcctgacattcccttttcgcctggagtcaggacaatttctgcaccgtaggcttttaaaatatttcttctttctacactcatagtttccggcatagtaaagatagctttgtaaccttttgccgctgcgattgctgctaaaccaattcctgtgttaccagaagtaggttcaataattgtggcaccttcttttaagagccccttcttttctgcatcttcaatcattccgtttgcaatacggtcttttacacttcctgctggattaaaatattcaagttttaataataatgttgcttttaatcctaactttttctctaaatttactgcctcaactaaaggtgtatttccaattaattcctgaattcctttataaatctttgccatgataagtgccccctattattctgctacagctttgaaagcttcatctaagtcttcaatgatatcatcaatatgttctgttccgatagataaacggattgtatttggtttaattccctgatctgcctgctcctgctcattaagttctgcatgtgttgtagatgccggatggattaccaaagattttacatcagctacgttagcaagtaaagagaataattccaaattatcaatgaactttcttgctgtcacatcatcacctttaatttcaaatgtgaaaatagatccagcgccattcgggaagtatttcttatataatctctgctgttcaggatcttcagatacagaaggatgattaatcttctccactaatggctgattctttaagtactctacaactttaagagcattctctacatgacgttctacacgtaaagaaagtgtttctaagccctgtaagaaaacaaatgcatgaattggagaaagtgttgctccggtatctcttaaaagaatcgcacgaattcttgtaacaaatgcggcagatcctgctgcatctacgaagctgattccatgatagcttgggtttggttcagtaagctgtggaaacttaccagatgctttccagtcaaacttaccaccatctacgataacaccaccgatacttgttccatgtccaccgataaactttgttgcggaatgaataacgatatctgcaccatgctctaatggtcttaaaaggtaaggtgttccgaatgtattatcaattaataacggaatattatgtttgtgagcaatctttgctactgcttcaatatctgttacctcagagtttggattgccaagtgcttctatatataatgcctttgtattttctttaattgctgcttcaaattcttctggttttaaaggatcaacgaaagttgtctctacgccgtagtctactaatgtgtgagcaagtaaattatatgtaccgccataaatatttttagctgctacaatgtggtcacctgctaaagctacattctgaatagcatatgttactgctgctgctccggaagctgttgctaatgctgcaacaccaccttcaagggctgcaaccctctgctcgaaaatatctactgtaggatttgttaatcttccgtaaatattacctgcatcttttaaaccaaaacgatctgctgcatgctgtgaattatggaatacgaaagaagatgtctggtaaataggtactgctcttgcatctgttacaggatctgcactttcctgtccaacgtgtaactgtaatgtttcaaatttaaaatctctatccttatatgttttctttgccatttttttatcctccatatattatgtactctttatattttaatctttagatttctaattaaatattctctctacaacagcagcacatacacattcgatcatccttatgtatgaattttctctttgaatttactaaattcatgtctgccacctctctttgttttgtgtttctttgtttcatgggcttatcataccagaagtatcctactatgtcaataggaaatatatgatttttgttttttcttttttatcccatgattttcctgtaaaatacaaaagtcatcacgaacagcttgtaatattcttctaatcttcttcctggtaataaaaattcccgcggataccttttgaaccaaagtaattaatgaatgcttccggatcttcctttttaatatccataactaacaccctcgtcgcatccgaattcaccacactgtaaagcattgctttttcttcatttttataacatccaacacccttaaataaagttgcatcatgattcgtctttttcaagataatattataaacttcatccggcttcttcgtaataataaacaaagtatctttatcatatcgtttatacatcatattaatcatctgtgtagatgcatactggaaaataatagagtacaatgccacattcataccataaatacatcctgcaataagaagaactgcaacatttcccataaaaatatagttccagacactgattccctttttcttggagattatcatactgataaaatccgttccaccacttgtcgcatgactatttaaaataagagcaattaatgttccattaataatcccaccaaaaatagaaatcaacaataaatcatccgtaacaaaatgagaaggaatcgcatcgactgcgatactggtcacaaaaatgcagagaaccgaacgaagtgtatactttttaccaactacccggtaacatatcgttgccggaactgcattaagaagtatactgaataatgaatatggcacactgatatgcaaaaatgttctgcaaatatgctgcagaagcaaggagattcctgtcgcacctcccggcagcagatttcccgcatttacaaaaacatttacattcaccgcatataaaatcgaagccacaataacaatcagcgaatcttttatgtcccttcgaatttccagcttatgatataattcctctcccatcttcttttcatcaagaatagctgaatcaggaaccagctcttctttgagttcttcttttaaatcttctctcaattcttttattggtactttcttcatataaatcctccaatcaaatgtatattccatttatcgaatctcattataatacagaatctatatctttgatacctctatatataatttttattttaagttcaccaaatacgcttctttttcgtttgtaagcaataatttcttctcctttttcacaatatacatctccagtgttccccggatttcttctgggatatctaatgctctataggtttcatcctgtaaattataaagataatacacatcatcggaatctgttcctaataaaacataatctccattaatctgcattatatgaacatcttctgcctgttttaaaggaattaccttcttttgttttgttataagattctctatttctagctgctttttcttcatatcacactgataagtccagcagcctttaatatcaccatattcaggatatactttcacttttccagtttcaagatcaatataatttagtcgatagaattcggtattgtttttggtaaatgcatctccaacagcggcaatatggtcatcattaatgaaatcatattcattagaaagtgcatagcctgaaagtccttctacttttctttccgtttcgttttctgtgttaaagacagtccaatatgatttgctgtgattgattaagatatattttccatctggagacatgctcatattcattccgtccccaggttttacgacctgtctacattctccactttttagatttacgcaaagaatttgttcatttcctttggcattttctacggaaaagtaaacttctccctgcttatttatctgatcaaatacctgcactagattttcgctgtaattatagccgaaaatctcctgaccgatgatggaatattgaaaagagaatgtatttctcttataactgcccgaaaaggattgcattggcaatttgctaagcttgccatctttaatgctataaactttctctataatttcatcggaatctccttctgttttactctcataaataaaactttcattcgttcccacaatctgaagactatctttcattggtactttttcaatttgtaaaacggagtctttcccttcatctgctttgttatttcttcggcgaactcttcctgtttcttcttcattacttctgccattttttcctttctgattatcagaagaactttttatctgaaatgtctgctcaatccaatcacgaaaaacagtagaaactctagccgctgtctgtactccaatgctcagcactataacacagatgacaattgctgcagcaactcttacaccagacagctttctcatatctttttctgcattttctgaagaatttacaaagaaaaatctccgaattattgatgattttcttttttggatatcttctgccgcttccctaataaagcgatcctcacaggcatcaatcgcacgaaacagttcttttttatccatcagatcaactccttttcctgcaaatattgctgcaacttttcacgaagtctggcaagtcgcatggatgctgttttttctgtgattccatagtcttttgcgatgtcttttaccggctgcaaaaaccagtagcggcgtaaaaataagattctttttttctccggaagttcgaaaagaaacgtattaattgccgtccgtaactcatcaaattctacactgtcatatgcttctgtcccatcactcacacattcttctagctcatcaagcgaagcttcgtactcactatttcgcttttttgcatgattaaattcatattttttcagagaaagattttttataatccggcatatgtacgccttaaatgggtttggttctttaggcggaatcttattccagagtgtaagataggtatcattcacacactcctcactgtcccttgtatcatttaaaatattgatggaaatcgaatgacacagctttccatactttacatcagtctgctcaatcgcattttcagaacgcttaaaatataaagcaataatttctttatctgtcatattgttcactcctttatttctcaagattcaccaaatagacttctttttcatttgtaaataacaacgcattttccttttgtgaaaaatatacccacagcgtataccgcaagtcttccggtggatttaatttcactgctattttcttttttatattgcaaagataagcgggcaaatcatccttgttccatataagaaaatactctttataaatggatgtttcatatgatggatctgtctctatatcttttatcagaaattctttacctgtaactatattctgaaataatgctgttttcttttttacactataatcgcaattccattctggagtcacatttccacattcggtatattctttcgtttttcctgtagaaatatctgtgtaatataaagtttcataatctccttcattatttaccttgccacctactgcaatgtgcgtagtatctataaagttcaatgtatcaatttccaaatttttattctctagcttttccaggttcttttcttccttcgtctgtaaatcaaaagaagtccactttctctttacacttccatccgactggatgagattatattgcaccaacgcatatctgccattcggtgccatcacaaagtcaatcactgtttttgaagccagctcactttgtatttcaccagtttttaaattaattacaacaagacgtttcccattttgactagaattttgcgtatattcttttgcagaagtctcaagaactgcataaatggtattcttctgcattactggaaaaactttttctaccgctccatgtatgttgtaggcaaaaatctcgttatcaatcgttgaatattcaaaagaaatttctaaatgcttataatgtccctcaaatttcttcttcaaaagttccttttgtttttttccctcaatcgaaaataccttctccactttttcttctattccatcataacttgtttcataaagaaatgtttcgttctgccctgtcatctgcacaccattttttaaggaaatcttagagtcacccatatctactgttttactatctggaacaatctccgtaacatcacatttctgaaaaacgttttccatccaatcacgaaaaagcatggaaacatgcgctgttgtctttactccaactcccagaattacaataaaaagaacaattgccgctgcaatacgaattcctgacaaatgctgattcttattaaagaataatctcttgaatcgatcctgctttttccttctgttttccatatccagaacaacttctttaataaatacatcatcacaggtattaatggcatcaaatattttcctgccgtccataaaaacctcctctcgcaaaggtaattttccaaacttcatatcaacttggtactttctatactaacaaatacgatataaaaacaaaataccacaaaaaaagttttgatttgtagattcggtgtagacgaaatttacaaatcaaaagttatcattctacatttttcaaagcttcgtccataggtacttttctgatttttcgatattctaataacgcaactgccgcatagcttataattccgataagaaacattttcacataaatttccggtgcaatgtacagggcaatccagccggaaaaactttggagcatcatttctcgaaagattactttcatgaaaatcgtttctaatggaaagcttaacagcagacacagcacaacgacaatggatgtcgataagatgtaaagcctgctgatttctccattattgtaaccaagtatttttaccatagagatagactgggcatttttttcgataatgattttggagagcaggtagataagtactaaaaagatagcgatggcaaatccatttaccagtcccatcatatttcccatagatacatctaactggcgggatactttagtgagggcatttaaatcgatgacggagccgatgtatttactgctgatatcggttatttctgtgtcagaaaagtagccgctgtaataatccgaaccaaggtcaaagattcgatttagctgattctgattcataaaaatgcaaagtcctccattataagcataaataccttttacccggaatgtgtgagattctttttcgtatttttcttttaaagtaatcgcatctcccggcttcaatgaaaatttatctgcataagcagacgaaatataaacatcggctgttatcttactgttttcctgcaaatctgccttttcatcttttaaattaattttaatatatttgctgtctgatctcacaccatacagtgtgacttcctcacttttaaatgtttttggtgttgtatttaaggaatacgcagaaaattcttctgcatcttcattttctgtttttgtaccaagagaatattccagtaaagaaaataaactggatagtttgttgctgctcatggcactggtcgggaccgaaagcatatactgatagtttgcgagcatattattctggatatctgtctggtaatgatcaagcacagatggtaaaagcagtccaaagaacagcaaaagatttgcaaaaacaattccaacaaataatacaatataattactaaaattctgaaaaataactctcagacggaatctcacaaaaatattgattttcgaactaagaggaaatgcttttttctgcttcctcttacttaagtctcttcgtaaaaatttcaatggtgataattttagttttctgtgcaatatcgcatagtttacaacaaacataatgaaaaccggaattaccgttgtaagcagaaaagcctctgcattccagagagttacatatgttggaagactgtaacttccgtagtacatatctgcacaaacatttttaaaaacagtatatcctaaaagattaccaacaatggctccaataaatgttacgagaagtggcatgaacatataatgccgtattaattcattttttgtatagcccgatgcacgtaatgttccgattactcccgcttcttttcgaatcgtattacttgtcgtaatcccaaatacaaaggccataattgcgataacaatataaagaagtacgatgatcattgcccgatcgcctcccatatcatctcctgtaaaatgaatagcctgattcagatactgtggtacaaactcttctagcgtaacatctttactaagttcttccataaaatcttcggactttttcttttcctgtgcctctgtttttggcttatggatatatgtccatgcataattatatacaagctgactttgattaaaagaagaaaattcttcttccgtcacaactgcagctccaaattttactgcatcaaacattgtatcattattattttgaaacagggcactgtaatctgagagagcaaccagtcctgttattttccattttctttttccactttgcaaactgtctccaacagataatttattattatccgcatacattctgtcaattgcaatttctccagttttttctggcagcttccctttcatcagacagactttattcaccttcgtcctatttttaaaaatacgaagtgttgtcccgttaagcaatgctttttctacataaaaattctcataaagtgttaccccttttttttcgatatcttcctgttgatttttatatattttttcttctgtttcaaactttccatcttcaatattatatttttgaaaactgttgttatatgctgttaacatacttccatcggctattaaaaatccagacacaaaaccgattgttgcagccataaggatgaatacaaccaaatacttcccgatttcttctcgaagttcccgaaaaaatctttttcttaaaggattcttcatgcccaatcacctaccattccagttccattgccggaatcttctgttcattcgtataatttttccgaatcattccatctcttaattttataacacgatctgccatatctttgattgcatcattatgcgttaccatcacaactgtatttccatatttttgatttaccgtttctatcaatctcaaaatatcctttgacgtattataatcaagtgcccctgtcggctcatcacaaagcagaatatctggattctttacgattgctcttccaattgctgttctttgctgctgtccgccagaaagctgatttggaagcttacgctgatgttcataaagtcctaatgtatgtaaaagctcattaacatcaagtggtttatcacttaaatatgctccaacttcaatattttcccttaccgtaagattcggaattaaattatacatctgaaaaatataaccaaggtgtattctccgatacaaggacagtttcttctctgtcatatcctcaatctgctctccttcaatcgttatacttccggaatctgctccatcaataccaccaatgatatttaacaatgtagactttcctgaaccagaaggtccaagcaaaacacaaaattctcctttttcaatttccagatcaataccttttaatacattaacctggctgtcacctgtaccaaaagactttttaatctgttttatttctaaaaacataagcactaacacctttctttctatttttatctcagtcgagaagactcccacctctttcaggtggtgagtgacagcaaatttgtctcagtgggagtccaatctccgactgagataaacgctccgcgaggatgcgcagtgattctgtaaa

SEQ ID NO: 472 - DNA, 11759 bp, Eubacterium hallii
gtagaagatttatcaaagacaagcacgatattcttacctttaagttcttcaccctgaatacccttcttcttttttgctttaagctcatgagccagatccagcatatagcgaatctcatctttattaaaatccagtaaagttaaaaaactacgtccttttaaattcatcttctattcctccaagtcaaaataacttactgcctgtaattactatttacatagtaaaagtattaacaaaatttatactacatatgaagaataatgtcaatatttctagtttaattcacttaacaaaccattcctctaaaaaggattatgttttttaatgagtgatataattcgctataaggttattatcaagtacttccttacaggtatctatcaaactctgggcacgatccgagtatttctgacaaagttttttgttaaggttctttctgctgccatctaaaagtgagattaatcttccactttctactgttccatcttttcctattgtaaatagcatattatcatcactggtgataaaggaaccttctcctacatacgaaatctgcgctatgaaaccttcatctgcattcaacagatcatgtccgaatacataaggttgttttgtatctaagtccatgagatttgcaatagtcggcatgatatcaacttccccgccaaccgtatctacaaccttactttcatttaatcctgggacatgaatgataaaaggaacattcagcatctcatcataatcatattcttttccaagaaagtctgtcattttccagcgaacagatggagtttccttattcatcccctgatgatctccgtaaatagcgatcactgtattgtcatacatatcattttccttgagatattctatgagtttaccaaatgcttcatccgtatatcgaaccgtttgcagataatttccaaaagtactaccttcgtcactgctttttaatttaagactcgctaaagactggtctagttcatacggaatatgattggtaagtgtaatcataaaactgaaaaatggctgcttctttgtttttaaaatatcaaccgcctgccggaacatttccttatccgtaataccaaatcctgaaatctgtgtttttttcagttcttcttctgaataataatgctgaaatccctgatttttatatgcctcacttcgattccaaaatgttttcacataaccatggaatgccagtgcactatatccattctcacgaaacatccagggtaaaccattatatgtattatctacatacatacgataacattccctgatatcatttggataaagaccattcagtgcagaaaattctgcatcagcagtatttcctactcctgttgttgaataaaaatgattgaaataaatcgtatcattctttaatagtttatttaaattaggggttatttcctgtccattatatgttgctcccactacaaaattattaaaagactctgtctgtatcaaaatcaggttcttttcctttgccacccctttataagcagtcccggatgacttcggtacaatagctttcattttcttttgaattgccttttcatcaacagaacttctctttaactttccgacaacattgacaaccacatcatttgtgtgatacgtaaaaaattcaatatgatttacctgctgcacagagcgaagattctgaggatttaatccataataataccatgcacatattgttacaatataaataataatgtgaaatacactcttaataaaagaagctgtaaattccttttctttccacaaacttttaaaagaaagctttgctggccaatgctttgccagttcatcgagcattcccttctttcctttatttcgaagacagtaccagtacaaaacaaatggataatcaattaatgtcaataaacatcctggacttacgcttgctccgatcacattaccatctcctgcaatctgtcccagacttgtaacttgataaagctgattgaccgatatatattttccaaaataactgctgtatgctgcatctgccagcataatcaatgtaatcaatgtgtatacaacgtaaaacccataccttcttggtttactttctttaaaagaaaatacctcaaatacacaaaataagaataacaaacttaacaatggaacgtcataaatacttaacatatccagtctttttgtctgccagtaatatataaacatctttaaaatcaataccggatacactaaccagtaatgcgccagtagtttttttattattgctttcataattttcaaacacactcaaatctgtaatttctaacattcgggtattaacttaaatcccgaatttcttctaatcaaatctaatcaaagataaatcaataaaactataaacgaattctgaaaagaaagaaaatctcatcaaaataattgatgagatttctcgatagtacttttatcatctggcttctgccttacttctcggtagtatctgcttcttctactgggtctggctgtgttgctacttctttaatagaagtaacgagtccggcaagattctgaatctcagatggaataataatctttgttgcttttccatctgctactttctctaatgcctctaatgatttaagcttaataactgcttcgtctgctccggcttctctgattgctctaagaccgtctgcggtagctgtctgcactttaagaatcgcttctgcctgaccttctgcttcacgaatcatcgcttccttcttcgcttccgcattaaggatagcggcttccttctctgcttctgcttcgaggatcgtagattctttatgaccttctgcacgaagaatggaagacttcttctccccttctgcacgaagaatcgcttcacgacgttctcgttctgctttcatctgcttctccatggcattctgaatttctgtcggcggaataatgttcttaagttccacacgattcaccttgattccccatgggtctgttgcttcgtctaacgtagcacgcatctttgtattgatcgtctcacgtgatgttaacgtagagtcgagttccagatcaccgataatattacgcaatgttgttgctgtcagattctcgattgccatgattggattatctactccataagcatacagcttcggatctgtaatctggtaatatacaactgtatcaatacgcatcgttacgttatcctttgtaataaccggctgtggtgcaaaatcaacaacctgttcctttaataaaactttctttgcaacgcggtcaataaacggtaccttaaaatgcataccaacagaccatgttccattatatgcaccaagtctctcaataacatatgcctgtgcctgcggtacgattctcacacaggatgttacgatatacacaactaacagtattatgataatcataaaaatcgttccaaatactcccatatattcactcctccttctgtttaccttacatcggctttacaattaccttcactccagaaatagattctatgctgaccttctgcccctcatgaagctttacctcatcggaaatgcttcttgctgtccagatctgtcctctcaccttcacctgtccctttgcattcaggttatcaatatcctgtgttacaagtccagtctgaccgatcagactgtctacattcgtcttaatcgttctgctgttaacatacttcaaggcccatggtcttgtcagaatcagaagaatcactgatataacagcaaatgcgataatctgactccacaatggcagagaaacggcagccattactgcacctaccagagcgccaccggcaaaccatatcgtagtaagacccatcgtcataatctcgatcacaacaaaaactgccgcagctaccagccaatacatcactgtcatacttccaccacctttctttacagtagaatatttccatctatgtatctactcctattctatcctatcctctataagaagtaaactaaaagtttcttaattttaaataataatttaaataataagatataccagccaggctgcaagccaggctatagtacactgcattatgacaattcctatggtctttaatgtcgaattcatttctcttttaattgcggctatcgctgcaacacaaggtgtgtataataatgtaaatacaaggaaacttgttgcggaacgaacagtaaataatgtgccaagtgcggcagatacatgcgctgcattcgttccaagtaaaacactaagtgtagaaactaccgcttctttcgcagtgattccagttacaagcgccgtagaaattctccaatctgcaaaaccaagtggtttaaaaattggtgcgatcaaatgtccaagcattgcaagcaaactatttgcactgtctgttacaacattcaatctgctgtcaaatgtctgtaaaaaccagatgatcatcgaggcaaggaaaataatcgtaaaagccctttctaaaaagtctcttgctttttcccacattaaaagcaatacacttttaaacgatggaaaacgataattcggaagttccataacaaatggcatcggtttccctgtaaaaagaactcttttaaaaattaaggccattaatattccaactgcaattcctccaaaataaaggcaggacataacaagtactcctctatgtgggaaaaaggcggctgtaaataccgtataaatcggtatttttgccgaacagcttataaatggaataagcatgatcgtaaggtttctgtctctttctgaagaaagagtccggcttgccattaccgcaggtacagaacagccaaatccaaggagcattggtacaaagcttcttcctgacaaaccaatcttacgcaggaatgtgtccataacaaaagcaatccttgccatatatcctgtatcttctaatatagataaaaagaaaaacaatattaaaatgacaggaaggaaactcagcacacttccgactccggtaaaaattccatcaataacaagactctttacaacaggattaattccgtaatttgtaagcagctggctcgtccctcttgaagcccagtcaattcctgcacttaatgcatcacataaaaatgacccgaacggcccaaatgtcatccagaaaataaataccataattgccgcaaataccggcaatgccagaaatcggtttgtaagtatattgtctatttgtacacttcgttcatattccttgctgacctgacactttactacagacttttcacagatattttcaataaagctgtaacgcatgtctgccattgctgcattccggtcaagacccctgtctgtctccatctcgataatactgtgttccatcatttcaagctcattttcagaaagttttaactgtctgatgatatcctgatccccttcaattacttttacagctgcaaaacgtccattcattccaatcctgctcacatgatcttccaactgatgatacagaccatgaatacaacgatgcaccggacccggtgtacaaaaatcgtaaaccttcggatactgcttattctcagcaacttcacatgccgtatggatcaagtcttccactccctcattccgaatcgcactgatcggaataatcggaatacccagtaagcggctcatttcctttacattaatagaaccaccattattccttacttcatccatcatatttaatgccagcaccatcggaattctcatctcaataagctgtaatgtaagatacaggtttctctcaatattcgtagcatctactatattaataattccatccggtttttcctttaaaagaaaatctctcgtaacaatttcctcatttgtatacggacggagtgaataaattcccggaagatctacaacagatccttccgcagaaccaacagaaaactttcccatcttctgatctactgtcacacctggaaagttaccaacatgctgattagagccagtcatctgattaaataatgttgtctttccgcagttctgattaccaatcaaagcaaatatcactgaacggatccctccttcaagattattttttctccatcctcttttcggatcgtaatatcatatcctcgaagatgaatttgtatcgggtctcccatcggtgccatcttaagcactttcacttttgttcccggaataagacccatgtctaaaaaacggcagcgtaaatctccttctcctcctaccgtttcaatcactccttcttttcccacaggtaactgtgctaacgtcatttgaaattcctcctgtagtttgttatgtactgatttttagaataagttgtatctaatcagtcatagtataagcttattgatactttttttcaatacccgccatccttccttctccttataattatcatattcttaccatatttctttgttatactattagcgatatgtgaattacgggagttgcgttagctacggagtaattcgtgacatcaagttaggggcaaaataccttttgaccctgacatcatatttaatcatttgtatatactctcgaagtcttctttgtagattctgagagtacatttatcaggtaaggagggtttacatatgacaaaattaaaacactttgccttttcttttgctttagccggagcattggcatttggcatgggcactgtaacaaaggctgctgaaccagcttccggaactactataacggcacctgcagccaaaacagatatttctcaaagcaaagatctttctattaactggaagaatacatctaaagaatatctctttgagggaaagataattgaaccagaagttatcgttacacaaacaataactgaaaatggcacaacgaaaacagtaacctggacaaaagataccgactacgcagtcaaatataccaataataataaagtttcttctaaagtaaatgaagcagctgctataatcacaccaatcggtgaaaaagcgaattcttacagcggaagcaaaacattgaattttacaatcaaacaggatatttctaaggcggattctggcatcacagcatcatttaaagatgccaaaacaacatatacttacactgctcctgcaaataccccagaagttaatgtagcagaaaaaactactgtaaatggaaaagaaactacaacatcctggaaaaaagacaccgattatgtaataagctttacagacaacacaaacgtaactactgctgcaaagcctgccaccgttatcattacaccaaaagcaggaagtaaaaaggctgaactttatggtggttctatcactttagcattccagattactccttgtgatattaatgactctcagatgaagatgaccgatcattatgataaagtttattctggaaaagcctataaagctggagtaaaactagtctatacaaataaaaatacagcaaaaactacaacattggtaagaaagaaagactacacgatttcaaattacacaaacaacattaatgtcggtactgctacaggggttgtaaaaggtattggaaactataccggcactagaaccatgacttttaaaatcacacagaagagcattgcagacctctcttttacgccaaatcttgaaaaagtcgtttataactataatggttcttacagaacacctgccgtttccattatctataaagatgctatgaataaagcaggtgcaacacaatcctacactttaaataaaggaacggattatacggttatttacgaagacaacaaaaaggtcggtactgctactgttatctttactggtaccggtaacttcaaaggatttcatgtagagaacttcacaatacgtcctaagtcaacaattcttcgcaaactcataaaaggaaagaaacagtttagtgtcgtatggaagaagcagactacacagatgagcggatatcagattcaatacgctacaaacaagaagtttaaatcttctaaaaaagtaacttctaaaaagtctactacgcgtaaaaccattaagaaactgaaatccaaaaaaacatattatgtaagagtccgcacgtataaaaaattgtatgatacgaactattattctaaatggtcgaatactatgaaaataaaaacaaaataaaattgtatttttttaaattttctatcgctttttttataaaaatgtattataatataattagattaattcatttcatgtattctgaataggattaatcactatactttgcataacagggaaaggaagaatattttcgactcgttggtcgttgaaaatatatcttcctttttcttttattataaaaactgatttaccctgcacatttcacttcaacccaaaattcaagtcgagccgcctgaaagaggtgggaatcttctctactgagataaaaagaacttcagaccatatcacttataaacatataatctgaagttcttttttatatctttttcttgtagtgaataaactctctactcttctttgagccagtttgctacatcaagggcatgatatgtaataatcatctgtgcgcctgctctcttcatgccaatcatattttccataacgattttcttttcatcaatccaaccgtttgctgcggcagcttttaccatggaatattctccacttacattataagcgcaaagtggcatatctgtttcccaggatgcggtttttaaaatatcaaggaatgctaatgccggtttaatgataatgatgtcagcaccttcatcgatatcatcctgaatatcacgcattgcttctcttggattatggtaatccatctgataagtttttctgtcaccaaagcccggtgcagagtgagctgcatctcggaatggtccgtagtatccggaagccattttagcgctgtaagccataatcggtgtcatctcatatccggcctcatctaatgcttcacgtattgctgcaacgtgtccgtccatcatgttagatggagctaccatatcagcaccagcctgtgcgcaggttactgctgttttagcaagcagtggaagtgtttcatcatttaagataataccgtctttgatcactccacaatgtccatgggaagtatattcacaaagacagatatctgcgataacgacaagttcaggaaatacctttttaatgtaacgaatcgcctcctgaatgattccatgttcattatatgcttctgttccacactcatctttgtgcgcaggaattccaaataagagaactccttttacaccagcctcgcgaatacggtctaattcctcatccagacggtcgatggaatactgatagattcccggcatagaatcaatcggattcttaatgtcctttccttcgataacaaataccggataaattaaatcggatgcacttacggatgtttcacgaactaatgcacgtaaattctctgatgcacgaagacgtcttcttctaatcataatacaactctcctaactctgatataaattataactgtaaacggttataaaaattacaactctaacgtttatattttaccacattggatgtgaaaagcaactttactgctcatcggaaccaatctgaataaactgaatcattccaggtcctaaatcttttgtcggtctggcgataaatccatgctttttatagaactcttccctcccttttgcacacataagatcaaacatcattgtggtcccttcgtacccttcctgaataacaaacttctttaaggtctctaaaataagaccaccgataccttctccctgcacttccggacggatgatcagatcctgtacatagcagatgattgctccatctcctacgattcgtcccatgccaactgcctttccatctttaaatgcaaccaatgtatacagactgttactaagtccttttttcgcctgatctcgtgtcagttctctaaattgaactgactgacgaagttcaagatacgtatctatatctagtctgtcttccactaactcaatcattttgtccctgccttattatttcttttatttcattttcggtaagaacccgctctttagaaaaggcttttgctgcggcagttttcaaaatatatctccgcattgcctcttcctcaaaattcgcctttacatactggcgaagttctcccataaaaattgcaatatctgcataataatccggaacagctttttcaatctggcaacgaatctgtttggatacagccgggcttcctgtcccgctattaattccaatactgatattaccctttcgtacaacagatgggaaaatgaaactggactccgcttcagaatctgctacatttacaaggatgtgatacgcatggcaaagttctgcagcacgatgattctcctcgcgactacttgtcgctgccacaacaagaaaagccttttgaatttctttttctaagaaatcgctttcctcgttttttatgaaatcttcaaaaatacttttttcatgaagaacttctttaatctcatcgcatactttttttgcaattacaacgatatccgctccgtattgaagcagcgtatgcacctttcttgcggcaacttttccaccacccacaataaggcaccgttttccttcaatttgtgtaaataccggaaaatacatcatctctacatctcaattcctatacgagaacttatgccctgatcaaatggatgttttacctttcggatttcggacacataatctgcgtgatcgattaatctctcagaaggatttcttccactgagaacaacttctaatgcaaatggtttcttctcaagatgttcaattaactttgcttcatctaaaagatctttatcgatagaatacacactctcatcaagaacaagcatatcgtaatcttttgccatctcaaaaagcttgtctaacatttcattattataatcacgaagctctttcagttcttcttcattcatctggaaagtaaacttctgcaattcttttcctgaaactacgttaatccctggctgtttttcaagaatacttctttcactggaactattatttttcaggaactgataaaaaagaactttttttccgcttcctgctgcgcgaactgttaatccaacacttgttgttgtctttccttttccgtctccgcaataaatgtgtaccagtccttttccggaagtgtcatcttttttaccaccacagcgtactacttcttctttttctccaaataatgctttataaaccgcatccatatccagactgtttcgaattaaatctgcgagcttattatactgtatttctttatattccgctatactaagatgattttcggcaggattaattcctttttctttcataatgtcctgtacaagggcaaatacaaggtcttcattatcgaaaattccatgtagataacttccccatatacgtccattctttgtcatatatgcatcggttcttccgtcttccaatgtaatcataggaatcgcctctccaagattctccgtcacgcccatatgaatctcatagccttctacagaaagattttcaagtccatagatattatgttcttctgcaatatgtccgttaattctcgttcttgtttttgcctctttaaatactgtttttgtatcaagaagtccaagtccacgcatcgtaccaccatgctctactccatccggatcatgcatttcctttccaagaagctgaaaacctccacaaattccaatcactctcgttgttcttgccgcgcggatgattgctccttccagaccactttcaataagccattccatatcacccatcgtattttttgtgcccggaagaaggatcagatctggatcaccaagttcctttttatcggtaacataacga

SEQ ID NO: 473 - DNA, 11491 bp, Eubacterium hallii
tcttacgggaatttttaagcatcctatttttgaatttacagaatgattatttttgaagctcagacaacacagcagatggagagtgttatgggaatgataaatgaatttgatacgattgctgcgattgctactgcagtatcgaatgcagggataggaattataagaatcagtggaagcgaagccatgacgattctttcgaatatttttgaaccatataacaaaaaagtggatgtgcatcagttagagaatcatcgcatttattatggaaatattaaggatggacaggaagtgatcgatgaatgtatcgtccttattatgaagggaccacacagttatacgaaggaagatgtagttgagattgattgtcatggcggagtcactgtggtatataaagtgctgaatcttgtactaaagaatggtgcgagagcggcagaacctggagaatttacaaagagagcatttctcaatgggcgaattgatctatcccaggcagaagcggttatggatctgattgattctaagaatgagatggcaagaaagaattccatgacacagttaaagggaggattatccgaccggataaagcagttaagagaagagattatctatcaggttgcgtttatagagtctgcattagatgatccggagcattacagtttagatggttttcctgaaaaacttttggaattagatagacagtggatcaagattgcaaggggcatgttggattcttatgataacggaagaatcatagcagaaggaattcgaacctgtattataggtaagccgaatgccggaaagtcctcttttttgaatgcattattaggagaagaacgagccattgttacggatattgcaggaacaacaagggatacgttagaagagtctgttacgattgatggaatcactcttaatatcgtagatactgcgggaatacgtgatacggaagataaagtagagagtattggtgttgagagagccagaaaagaaatggaaagtgcggatttaattttatttttgatggatacttccgtacagatcagtgaagaagatatagaaatacttcagaagatacgtgataaaaagaagattattttattgaataagtcagataaagttcaggaagaaggcagctttgattcttctgtattacaggagtatatttctgaagagacaccagtgatctctatttctgcaaaatatggagatggaatagataatttcataatggaattaaaaaatatgatgtttcatggtagaatagatgtgaatcaggaagtttatattacaaatgcaagacataaagatgcgcttgcaaagacatatgagagtcttgaatgtgtacaaagaagtattgaggcaggaatgccggaagatttcttcacgattgatcttatgaatgcatatgaaaaactgggattgatcattggggagtctgtagaagaagatttagtaaatgaaatattttccaagttctgtacaggaaagtaacaggtcatgcgctgcatgacgtgcatctcacttcaagaatgcggaagaaaaatgtagaagtattcttgaagtgaagcaggtattttagtgtagagaacttatttatggaggacttaatgaagacagtagaagaatgctatgatgtgatcgtagtaggagcgggtcatgccggatgcgaagcggcccttgcagcggcaagacttggatgcgagacgatcatttttacagttagtatgaacagtgtggcgttgatgccctgtaatccgaatatcggaggaagctccaagggacatcttgtaaaagaaatcgatgcgctcggcggagagatgggtaaaaacattgataagacatatatccagtcgaagatgttgaataagtctaagggaccggctgttcattctttaagagcacaggcagataaagatgcttattccatgacaatgcgttatacacttcagaatacagatcacttaacgctacgccaggcagaggttacggagctgattgtggaagatggaagtattcgaggagtaaaaacattttccggagccgtttaccatgcaaaggcagttgtcttggcaacaggaacttatttaaaagcaagatgtctgtacggcgaagttgtcaattatacggggccgaatggtttgcaggcagcgaactatttaagtcagtccctaaaagataatggtgttgaattataccgttttaagacaggaactccggcaagaatcgataagcgttcggttaactttgatgtgatggaagaacagtttggcgatgaaaaaatcgtgccattcagttttacaaataaggaagaagatattaagagagagcagatttcctgttggttaacgtatacgaacgaagaaactcataaaatcattcgagataatttagatcgttcaccaatctatgcgggtgttattgagggaaccggcccgagatattgtccgtctatcgaggataaagttgtccgttttgctgatagaaagcgtcatcagcttttcattgaaccagaaggtgaatttacaaatgaaatgtatgttggtggtatgagcagttcacttccggaagatgttcagtatgagatgtatcgtacggtaaaaggtctcgaaaacgtcaagatcatccgtaatgcgtatgcgatagagtatgactgcatcaatccgaatcagttaaagttatcactggaattcagaaatattcagggactttttagcggtggacagtttaatggaagttcaggatatgaagaagctgcctgtcagggactgatcgcgggtattaatgcagcaagaaaatgcactggaaaggaaccggtgatactggatcgttcgcaggcgtatattggtgtattgattgatgaccttgttacaaaggaaaaccatgaaccatatcgtatgatgacttcaagagcagagtatcgtcttttattaagacaggataatgcagatatgcgtcttacaccaattggacatgagattggtctgattgatgatgaaagatatgagaagttccttttaaagaaagatcagattgaaaaagaaattgaacgtttaaagcatgtaaatatcggtgcgaacaagacggtacaggaattactggtaagtttgggaagttcccagttaaatagtggttctacattagaagaactgataaagcgtccggaacttaattatgaatctttagcatccatcgatccgggaagagagccgttagatgatgatgtgatagagcagattaacattaatattaaatatgaaggatatattaagagacagcttcagcaggtagaacagttcaagaaaatggaaaacaaactaattcctgacactataaattatgatgaagttcacaacttgcgtaatgaagctgttcagaagttaaaggcagtacatccacattctgttggacaggcatctcgaatttcaggagtttctccatcagatatttctgtactgatgatttatatggagcagatgagacataagaagtagcagcgtcttacaggcggtgagaaataagaggaatatatggagtttaaagaaaagttaaaagcccgggcattaaaggaagaaatcagccttagtccaaagcagttagaccagtttgaactgttttataatatgttgatcgaaacaaataagtcaatgaatttaactgcgatcacagacgaagatgaagtaattgaaaagcattttattgatagtttaagctgtagaagagtcatggatatgaccaaagtaaagacttgtattgatgtcggaaccggtgcaggttttccgggaattccattaaaaattgtttatccggagattcagtttgtattagtagattctttaaataagagagtcggttttttaaatgaagtcaaaaaagcacttggactagaaggtttagaagcacttcatggaagagcagaagatttagcaagagataaaagtctgcgagcttcctttgatctgtgtgtttcaagagcagtcgctaatttgagtgtgttaagcgaatactgtattccatttgtcagaacaaatggatattttgtatcctacaaaggaaaaaaaggattagatgaaataactaatgcacaaaactgcatgaatgtgttaggatgtaaaatagaaaatgtagatgaatttcatttagaagaggatgaagcagaacgtcttttaattaagataaagaaatgtaagggaacaccaaagctttatccaagaaaggcgggaacgccgacaaagaatcctctgtagataatcgaggtattcttgaacatgtcagaaagataaggcagattagtatggatatgaaagaaaagaatgatatttttatagataatacaaatttgcagggaaggatgtccgtttttcatgataaactaagaaagcatctttctaatgagtatttgtttttatctgagaaaaaagataatctggaaaatgagattcttcaattaaaaatggagaaagagcaaaaggataagacattgttccctaatattgggaagaaagatgtcagaaagtatttttctcctttaaatataagtgaaattgatgaagatcagaaggatgaaaaagaaaaacaacttcttgccaatatcagcagaatcagcgaagaagcagagatgctagatggaagaatgttagagattaaagactttttacaggatatagagaccatgctagatgacgattcaaaagatagtctttccggttttttattaaagaaagaaaagaatcggattactgtagaagatttttataaaaagcatgaaacccatccggaactactgaaaaatttaaaagagttagtaacattttttcaggacagatatgatgaattagaaattcttcttgaattcgaagatgaaggaatacagctagaaacaagagttgtagcgaatatattaagacaactgacgatcaatattgtatcagccgtagaagactatgatatttccatgatacttatagaaggtaaagtcactgaggagaaaatcatccttaccctgaattgtatgtgtgaagatggtccggtagatacatttaagatatcctatgatatagacaggggataaagttacctgttgcgatcaaacataaaagagcagcttggaaaaatccaataagaattctgataggaaagttttaatacgaaagttctgatacgaaagtattgatacgaaagtttctgacagaatcaagtacagtaagattcctagaatatataaaagaaagggagtaaataatgaaaaacaaaattattgatattttatctgaaaatatcgaacagatgagcaaagaagatattgcggcagctttagagattcctaaaaagacagatatgggtgactttgcattcccatgtttccgcttagctaaagcatttcgtaaagcgccaaatatgattgctgaggagctgaccgctcagattaatgaaaaaggttatgatatttttgataaagttgtaaatgtaggtgcatatatcaatttcttcttagcaaaagaagcatttgcaaaagaaattatgaaaactgtggacactgcagattttggagctggaacagaaggtgaaggcaagaccgtttgtatcgattattcttctccaaacgtagcaaagaacttccacgtaggacatttaagaacaacaatcatcggaaactctctttataagatttattctaaattaggctatcatgtagaaagaatcaaccatttaggagactggggaacacagtttggtaagctgatcgttgcttataaaaagtggggaagcaaagaagctgtagagaaaaacggaattgatgaactgatgaagatttatgtaaagttccatcaggaagcagaaaaagatgattctttaaatgaccaggcaagagaatggtttgttaagatggagcagggagatgaagaggcacttgctatctggcagtggtttaaagatatcagtttagtagaatacaaacgaatttataaattacttggaatggactttgaccattttacaggagaaagtttctatcgtgataagactcatgaagtagtagaaaaacttcaggagaaagatttacttgtagaaagtgaaggcgcacatatcgtatcattagatgagtatgacatggctccatgtctgatcatgaagaaggatggaagcagcatctatgctacccgcgatttagcagcattattatatcgtaagagaacatataactttgataagtgtatttatgttactggattagagcaaaaacttcattttgcacaggtatttaaagtaatcgagttattaggatacgattggtatcagaatcttgtacatgttccatacggattagttagtatggaaggtggaaagctctccacaagaaatggaaatgttatttatgcagagcagatcttacatgaagccatcgaaaagattcatgaaatcattaatgaaaagaatcctgacttaccaaacaaagaagaagtatccagacaggttggaatcggtgcaatccttttcaatgatttatataaccagagaatcaaagatgtaatctttaactgggataagattcttaactttgacggagaaactggtccatatgtacagtatacgtatgcaagatgtgccagtgtattccgtaaagtaggagcggttgaattacctgcagaagttgattattctgtattaacagacgatgcaacaatgaacctgttaaaagaccttacaagattccctcaggttattaaagaagcagcagaaaagtacgaaccatttatgattgcaagatttgctgtatctgtggcacagcactttaataagttctatcatgactgccagattaatgtagaagatgaaaatgtaaagatggcaagattaaaagtagtagatgtaacgatgagagtcatcaaatcagcattagacttattaggaatagaatgtccagaacaaatgtaattaactatttgattcattagagaaaacagacgaaaataaaaataatagaccataacaaatgtaaagatatcactgcgtagaaaatgcctgttcggcatttttacttgctctcacattacatttgttatggtctattatttttattttctgcttgttggctccagaaggaatgaatgcaatagtctttgggagcaattaagggggaggcggcagatgtctattactactcagaaagtattcctgcccggcatttttacttgctctcacattacatttgttatggtctgttatttttattttctgtgttttggctccagaaggaatgaatgcaatagtcttttggggagagaagggggagaggtcaggagtctactacttactctctccgttatgctgaaccttttttcaagtttcactgatgataagatgatactgaaagctatcactatacatgataaatttatcattatattgtctcgatatatcgtttgtctcaatgtatgtcatgcgttacatgatgcacatctcgtagcaagaatacgaaagcatctaagcttctgacgatacatcttccgagcaagcaggaaactttttgacctcttccccttatccctcccagatactattgcattcattccttctggagccaacacacagaaaaaagaaatactaccatatcccagatgcggcttcggagcgtgtttaagatgcagacaagcatcttaaacacagcgactacagagcagatgggatatggtagtatttcttttttcgtctgttccctaatgaatcaaatagtaaaaatgtttcacgtgaaacataatatctagcgtgatatcttatttcatgttataataattccgataagttgcaagatttgaagtttaaaatttgaatatggaagaatttgattttaaattttgcaagtttataggttttatatgatgaaaatatggaggtttgtttatgagcagagtgattgctattgcaaatcagaaaggtggagttggaaaaacaacaacatccattaatctttctgcatgtcttgcggagaagggaaagaaagtccttttaattgatatggactctcaggggaatactacaagcggttttggttttgagaaaaatgagttggataaaacagtttacgaagttttaagagaagaagttagtattgaagaagcgattattcctgtagaggaatgttttgaaaatttatttttgattccggcaaatagaaatttggcaggagcggagattgaattagttaccagagaaaatatgcaatatattttaaagaaacaattagaaccgattaaagataattatgattttataattatagattgtccgccggcacttggcatgcttaccgtaaatgcaatgacagcttcagattctgttttagttccgattcaatgtgaattttacgcattagatggtctttctcagttaatctatacgattgaattaattcaggatagcttgaatccagatctgtatattgagggtgtagtatttactatgtatgatgctcgaacaaatctgtctttacaggttgtggaaaatgtaaaggataatttaaaacagacaatttataagacgattattccaagaaatgttagattagcagaagctcctagttatggtttaccaattaatctttatgataagcgttcttctggtacggaagcttacagaatgttagctgatgaagtaatcgaaaacgcacagtaaaatagagacgagtaattaaaatgtgtaacgtttcacgaattttataatattgtttcacaagatagaatacacaatgtttcacgtgaaacattttcaagtttagatgggaggagcatatattttatggcggttagaaaaggtttgggaagaggattagaccttctgattccaaaagatgaaagtatgcctaaaaaatcgacaggaaaaaataaagatacacaagaagcagcggagaatcagattcttacactcagtattcatgatgtggagccaaatagaaatcagccaagaaagcaatttgatgaagatgcgatcgaagagttagctgattctataaaacaatacggagttattcagccgcttattgtacagaaaaaagataagtattatgaaatcattgctggtgagagaagatggagagcatgtaagaaagccggattaaaagaggttcctgtaatcataaaaaattatgatgaaaaggaaacattaaagatttcgttgattgaaaatcttcaaagagaagatttgaatccaattgaggaagcaaaggcatatgaacagctttataatacatatggattaaaacaggatgaaattgctgctagtgtatcaaagagcagaacagctattaccaatattatgagactgctcaaactggatgaacgtgttcaaaatatggtaattgaaaatcttatcagcagcggacatggaagaactcttttatctattgatgatggagatgtgcagtatcaattagcagaaaaaattcttgatgaaaacttaagtgttcgagaagcagaaaaactggttaaaactgtaatgaatcaaaaagaaaataaaaaagcaaatgaagaggagtcattgcaggaaaagagtatgattactttttttgagaataaaatgaaggatattcttggaagtaaggttagcatcaaaaacaagaaaaataataagggaaaaatagaaattgagtattattctaaagatgaattggagcgaattatagatttaatccaaagtattaaagaatgacactgttaacagaagataatggagaaaaagtatgaatagtagaatattaaatttctttaatgtgaaactggatgcatttattgtttttgtatcagttgtagttgtgatcatgtttatagcactattctttcttcttttagattacttaaagatgagaaagcgatatgtggaatttatgactggagaaagcggaaagtctttggaatatacaatttataaaagattcagggagattgacaagctgaaagctggccagaaagataatgatgctcagattgctattatttatgatatgctcagaagaaattacagcaaggtcggtatttataaatatgatgcatttaatgtagaaaattctcttagcggaggaagtatcagttttgctcttacacttttaaacagtagagataatggatttatcttaaatgtaatacataatagagcaggatgtcatgtttatttaaaagaaattaaagaagctgcatgtgaacaggtattagcagaagaagaaaagatttctcttgatatggcattaaaatatgacgaaaaaaaagaaacagataaataatatgatactagaaacaagatacctcttgattccaacatcataatatataaacacaaaagaaaaagagttaagatatgttcaattcacatatcttaactcttttaacttgctttctgaattatataaatatataatgatgatacggaattataaatataaaaggagtgagagggagcggcatatatgcgagaatatttaaaagcaattggttttagtgatttgaacagcagaaaaaagatagacgaactaattaatgaaataaagaagaatcccagtagaaaaaactggtttcaaatagacgaagaagaagcaatatttatttacgaaaaagattttgctgaagcagtaggaattgcagtaatagaagttatggatagagatggatatcgggtaacagatcatttttatccatatgttcgcggtgcgaattacctgtatcatgaagatttagaatttgaacattatacagataaagaaggatatgcgggcatttgtgatgagaataatattggtatcccactaatatttcatgtaaataatccagtagactatttaaaaatagtttatgggaagtttcatgataagataaatagtataactttatccggaatgtcaaaaaagggaatgattattttaccagtcgaaaaagatgaatttcaggaacgggaagaacgaaaaggaaatgaactccgtaatgaaatgatcgatgctgcaaaagcaggagatattgaggcaatggaacagctgacactagaagatatggatacatataccgcagtcagtagcagatcaaaaaaggaagatctatttaccattgtaacatcgtattttatgcctcatagtgtagaatgtgataaatattctgttcttggaaaaatcatcaatgtgatggaaatgcagaacagcagaacgaaagagatattttattacttatcagtagagtgcaattccattcagattgaattcactatagcaaaagaagatttgatgggtgagcctaaagtaggacgcagatttaaagggattctttggctgcagggagaagtagactgcctgtaggcttgacaaaagaaaaaaaataatttaatatactttatgtatgttaatgtgtcttcgtagctcagctggatagagcactcgcctcctaagagaaagccgaggcattccccaaagggaaaaaatgaaaaacaactttcagttcgaatctattctgaaaaatgc

SEQ ID NO: 474 - DNA, 11443 bp, Eubacterium hallii
tcccttgtcgtcattcccttcgcatacatagaaagtacctgatcttcaatgtttgagatatctgtctgattctttttcacaatctgcggttcaaaatctccctttcgatctcgtggtatatccagatcgatcgttcccattgaagaggtaactgttttaggactataaccattacggctatcgtctgtctctttgttcttgtagtcatacttggaatatccaaggtgatcatccatttcagcttctaacataccttgcagcgtttcgcctaacaaatccttgagcatgtcctggatatcctgagcatcctttggttgatagtgttccaacaagctgttgatgaacgctttgcgttctggatccatttttcttcttcgtgccataaaaaatcctcctgaattgatatttattttaacatcaatccaagagaatatatagctcttttagagtttacacagaattaattaccgtcttccggaacattactatccatcgtatcaaaatactgcaaatgctgctctacttcatgaccacagcccggacaaaacttcgccttctccggcaattcgcttccacaaatcctgcacttcctactgctcataccgctttccacctctcatatctgatcgggcacactgacctggtctcatgctatgtaataaacgtacctgccagttgccggttactttcctgaagttttattataacaggaaatgattcggatttacagaccgaaaatgtcagtaaagtgtactactgtcacacttctacattcttcctcttaaatactgatattgctcaacaaatttctccatatatttttctccctcttccatggacattttcttcccattgcaaaagtatcctaattcctcatgcttgccattatgccattctaatgtttctatttttttaagttttccatctgtatattcatatatgttatactcgcatccaccagtatcctttctataaaagacaacctgatgcttttcttttgaataaaacatcgttttcgcctgccctaacttataactatacagcttttttatcgtatccttctttatatcatatctatacataatgctgtacggaatgaaaccttccaggcaatcaaccataaaaaattcaggaatcccatctccatcaacatctgcaatatcatatatctctttataattctcctttaaaaatcttatataacattgtactgctttttcaccttctggtattaatttactttcttccttcctatattctgctataggctcttccaccatcttcccatcatccaattttttcttaaaccatatacctgtttcatactcatccccgtagtatacagaaaatacaaggcaatctttacaaatatcccaggcacgattataaatatttcttccataattatcataattttcagtaagccattttaactttcctgttttcaaactaaattcatataagtcgctgcctctctgaacatacgcatatttccctttaaaatttgtaattccaaaccattcccctttgcttccaaacatagcttctgttaatatcacttttttattttttgtcgttatgtcgtattcataccagattggattattactatatgtatttgtgtaataaattttattattatatggataaaaataatctggcaactcctgatttgctgtttcttttagtacaagttggggattacacgttttttgggtaatatcaattctcttaattccatctgccgcataataatacaaatatttcctgtccattatatgatactgacttcgttcatactcttttggaatcctaaacagctcccttttttccccttttttatctatcctttctacatatccttcttcagaactttccctgtcattccatgtacaataataaaccgcttcgccatctgtataaagatatgttgctccttctgtctgagacagagtcgtttccttttcagaattttcttcttttttaatcagttttcgtaaacaaactgtctcatcataatcatcaatatatatattcccatccattataacaaaattagcatcttcatcctgcaaataatatacaatatctgtttccattccatgagacttcgtcatattccttcgatatagaacatgtccttttttataataaatgtatccattataataagtgctaaaagaattattcgttccattttctaaagattcgtattcttctacagcactatttttttcatttactgtttcctttttgctggaaatactatttctatcttttactgtttcctttttgctgacagtactggcaatatcctctttatttttataatagaataatcctgttccgcccataatcacacacagcaatagtatgactggaaatattttcttttttctatctgtattttgtttgtctatcatgcctctactccctccattctggctatgattatgagcatcagaaatttcttttatttagcattcaccaattcatataaccgtctatccagataccttttcaaaatcccatcttcatccagaccagtaccaccataatattcttctgccactgctccaccaattgctgcaagtgtatcactgtcgcaatttaaccgaaatacatttctcaggaaactttcatatgaatcactttcataaaaacaccgcatcgccgtcgcaacacttcccatacaagtcgcattccaacgataaatacgttcaagctcgttaagcggcactgcaatactatattcatatttttcagccggatactgctctaatacatactgaagaatctcctctttactctttccatgcttcgccatccagatacagactgcagttaccaccgctccctttatcccctctggatgattatgcgtaacctctgcagacttctctgcccacgaaatcacatcttctaatgtatcaaaatactcaccgacaaaagaaactctcatagccgaaccatttccaaaactattatatggcttgggattcccaccgtatatccagtcataaaatttttctccgtatccggcatgaggatatggttgtccaattgcccgcattgttttaacaaaatccactccttctaaaatcgcttttttcactgcaagtgtcattaccgtatcatctgtaaaagaacaataattcgtaaataactcacaatgcttataatccaggttatctggtctgaaaaattcaaattgtgaacctgcgatatctccaagaattgctccaattactgccataagttttctcctttctctaaatacaaaatcgtctatcaattgccttttgatgttttattatacaataatgtcagtataatataaactcttcaggtttctatatttttccctcagtgatttccatcttctctgcccctgatgcctccttagtaataagtcctattttcatgcccattaaagactgaacaaaatacttgcgctgaatccgttcaactttaataggatattccaaataaaagccaatcagagccagtacctgttccggttttgtaattttttcatcaagcagatagatattcatacaaagtaattccgataactccaccttgcaaagtttactctgatttcctttaccatctcttatataaataagtggcaattttttatagcaggcattcttttcaacaataatccgctttctctcatttgctacttcaagatattcagaaagtccaatatcttcataattagcttctaatgatttaagtcgaatataaagccttcttaaatctggcggattttcattatcaagcttatgaaaacaactatacacctctggaagtcttttaagctgtaaattcctatgcaaaatctgtaatccaccataagaatacagaatatgatttggtattccaatctcccaatcatattcacgcagaagctccccccacttaaaagaattgcacttactttctttatattccagaatcgcattgttgatataatccttctccatagaatagtggaaagaatagtgaaaaagcatttccaaccagctctcatattctgcaatgtctgactttctttcctgcattaagaattccatactgtcaaataacagtttattggtatatttgggaacatctactgtacaccattcatatatctgatacagaagcatggtgcacagtacatcgttcgtaatcttttcagtaacgtaatccgggatatacacttttatttttccgcgaactacttcattccaatcaatcttttcaacctctttatttactggtatttccagatttttactataaaatgaatatacttttttcccatttttatattctgactttctgaaaccagtcagaatataatccgtaaccccctgtccataccaagtctccatcactacacagtaaaatgagtaatactgttcgaacattctggaagatcgattctctggcactcctgctaacagtaccagtaagctttccctgatatcacactccttaaaaatgtcttgcaccgttttcaatatatcttcctcccttgatgaatatcggagcctctccctgaagcattcctttatgaatcttcatacaagaatatcccccgaccttcatatcatagaaatatgcgttatcagcaaactgattcataatatttttcacagaacgagcaccagcattttctttcacaataagatcgacaatcgcttcaaccgtatcctcctcgataatgagatcaagcccagaatcattataaattttcttctttttagtaaaaataccgatatgttcatccataagaatggttttgagttcatctcttgtaagcttatgaagcctgatgatatcttcgatacgcccaataaactcaacctctccaccaatagcaagcatctggtcccggacagactccttaatattaactttgcactctgttgcagcattaaatccaagtggatttctgtccttctccttttccaactcatcaattctgggaaatgctccacccagaatgaacaaaatcttgcctgtatccaccccttcgatcgtctccgttcctgccaaagcagacaataactgctgttgtaccatggcatttatattatcaccccgactatcgtgattcctgttgataatcttgtcaatttcatcaaggtaaacgatacactttccatctgaagagccaggtcggtcactatccctacgcatccattcaaagagcggaccacttcttgtaacctctctcacctttttgaaaatcgcactaacatcggcaccactaaaaccattcggagtcaatgcactgcaatcataactaattacaggcattcccaaataaggaaatgagctgatcgtttcaatcagatagttctttcctgagccacttggcccgatcatgagcattgtggtacgtacatcatagtacttccactgagtaagcacagaacacatttttttcttcaataaatcctgccccacataatacttatccatatgtgcatgacactcagacataaattccatatctgtaattgtatttgtcgtagtattgtccccctccttcttttcgactttttcgacctttttgacttttttgagaggctctaaaaaaccgaactttttatataccttctcaatctctttccaggttttatgcggatgatacgctttctctttcacaagataataataacgaagaagccttcctgcatataaaatttcactttttcctgcctcctcccacatatgttcaaatacatcatccttatatgaaattttttcaaaatcctggagatagctgtattcgccagtagaagcaatacgatataactctttcatcagtgcaagtactgtgcactgatcgatattccagttttttttcatataactaaagatttcggaaatatatgccagtgcatttctggaagtagtatccagaccctctgtgatttctccataactatcttctcgcatctctggctcaattacctttatttttttaatcatctcatctggttcataaagaaataatttatccatttctaatctcctatatctttggtagcatcagatcatactgttttttccaaattattcttcccacaaatgccactagaatttcttcaatacttgtacatattaaagtcagcccaaccattaacagaatattgcttaaaccatgataactatggaagatgtattttttccacggcaaaaactcattcactaaaaagatattaattggaatactgcaaataccacaaagaataaacaaccacaagttttctctcttatgggtaaacgacaatactgccaccataatgaacatagttattactgttacagctacaagccaaaccgatttgtaataggcagctataacagctaataaaaatggactccaaataaataattctgttttatgcctcatatcgttcctctactttcttttacataacaagattattaatcatgctcactatgtttatgattatcatcatcggtaacactccctgcataataacaatgatgtaacatgccgcaatcgtagctttcccattgatacctcttcggcgaagcttcttcttaccttttttatctcgaacaagcttctttgcccgttctacgaaatcatcactgcctgtgaaaatctccccaaaaatccccataccatcaagaccttcgattaaagtcatattgaacactgccaggatcaaattaagaactgctgccactataagtgcaagtgaatcgataacccctagcttgagacagcaaaggaataatccacaaagggcaatgttacattcaacacctgccgcaataatctgtgcacgtttaaaacgatttttcatttctgaataatcaataattgcatatgcccctagtaaaaaatagcgacacatgatacccatctcaaaaaaatgattctttgaactataaccaatgcatgcaaagacatgacttaattcatgaagcaacattcccagacctatccccataaaatatcctttcagaataccatgaccagttgaaacaaatttccagtcgttactacataatatgtatacacccataatgaaaagtggcagccatataaaaataagaattttattccagattgcaccaaaaattctatgtcgtcttgtaattcgaggtatccacaatggaatactaatcgatcccagaccgaattctatccttctattaactttatcaagaagctcctctttttccatccattcaagaatgatatccacttcctcctcaccaatctgatcagaataaatatcatatggatttgtcctgccgtctaacttctttaagaaatgagcatataatgctgtcatttcccactcatcctctgtcacgaaattcttaatattatatttatcatgactgattctgttaaaaatcaaataacgattgtatctagggtaactcataaaattcctccccttcccaaagaaactattcctctcgtattcttcgtttctttaacaaatgaacatcctgtcctatcctctgacattctaaaatcaacacctcatcatttgctatattataaattgtccggtatttgctaacttcttcatctggcaaagaaccaatatagttttgaatctgcttatatgtataatggggaattactgtatcagaaaaattgccctccctgggcaacagattaaatcccgtaaaatcataaactccggaaaaatttgaatcaaaatccaaagcacacttaaatcgtgctgatgcaagaattgctcctgcagacgaaccaatataagttgcaccattatcaatcatgttgcataaatacgtgtcaaaatgattttttcgaatataatcaatgatttcaaatgtatttccctctgtgacatatatcgcatccacttccggcatctcacaaattgattttccctcaaactctttgacaaggaatatattttcaaatcctaattcttcgcaatttcttacaacgatttcatctacttcatacctgggaaatgttataagaaatatacttccatattttattttttctttctcatatgcccttctaatcaaaatggttcccttgcgtgtattaagcccttttgatgttaaaatcagtttgtatgtttttgatttactcatcaaaatcctcctattctatcatctaagaccgaatatcctgaatcatgtccttctcatgccgattgaaactgtaactgaacagaatagcaaacgtactggtcaacaacatgcaaacagtctgtctcaaaattgatttagtatattttgctgttggtataacatatggcaatatgtcgtacctgtatcttatgagataattatatcaggaaatcaataatctgtagttactaaaaaaatcttatttgtttccattctggaaatttatctgatataattgataatcagaacatacattattgaatggagacgatttgatgtacttatgtataggaaccttattgaaattaatagatctatatagcaacggtgtatatactaaacttgcaatatgtcaggaactattttcatttactgaaaatgattacaacaaaagcgatgcttccgagctcatcaattgcaatatgaatataaaaaaacacgagagaacctatattatgagctttaatctccaaaacgatagacaatacaatcgtttacataaactcctagaaagcaccgctaattttattctacgtgatgcgttacctattgataacattggtccttttattcaatccgtattaaccatcatgcaaaacgatgacagattagataatgcttttggaatgaatcccgagtatacaaaagaaaatatttttagcactttcaaagaacttgatgcaacagaatttttaatcaatattttatactactgttatattctaaaggacaatagaacgggaaaagacaccgtcgtaaattgcttaacacaaaactttatcaaagaacaatcctttgctgcgaataatatctttattagaaatattaatggatataacagatacacatatcgtaaaaattattctgatgaaaaattgcctcatgaattgactcctaatactactgttatcgacggatcctcttcaaatattttgtatagagaagacaaatttcacagtattgtaaatacaatcaggtctaatgaatcgaaaaatgtatatctatatggtatgggcggttgtggtaaaacaagtatcgcacgaatggtttattctcatttaaaagattactacgattgctgtggctggattaattattctggaaatctgaagcaaagtatgatagattccattgtcttagatgaatactctgatgaaactatgatagagtacgattctcagaaaaaatggcagatgcttcgaagaaaacttacaaacagcaaacagacaaagttatttgtaatagataacgttgattatattgagcaaatacaagaccccagaacagacaaagacttgatatccatgtctacctggaataacactacattaatcatcacctcaagaatagcaagtattataggttataccaccaaacgtgttcttattaataacttaggtgataaaaataatgacgaaaaatgtatagaactcttttatcactataatgaatctgctgcatcaaacagagataccaatcatgaggcagttgcaaatctctgttcacttgctgattataacacaatggtaattgagcttcttgcaaaaggaagttactactacggagaagatttagacgatttctatcaagacttattaaaaaataatttcagttgtgccaacgatactccaatatttaccgaacacgatttcacagtgataaaagcaactaatgctgataactattatgacataggaaacgaaaccttagcaacgcagatatataagctctttaatctcaaaacaagaagtgaacttgagcagctaatattatgggatttccattgtctaaaagagaacgaaaaagtaacccgaaaagagcttaaaacctggatgggatatgatcctaaagactttgacaaattagttaatgaaggctggattacgtttcaggataatctcttctttatccatcctttagtgaatcaagctatatcctgctcagaacaggattgggctaagtattggaagtggtctgaatataggcgacagcaagaaaaaactccatcattggtaacactagtgaaaacccacaatttgtttatgaatagtgatacctttgatacaaaaatgagaaagatgtatcttgcaaattatctatcttatgaaggaagatttcttgaaccagaagaactaatatatcttgcagataatgccagaagaattggtgcacgagaacttggtcttaaattctataaagcaacatatgataaattgactgtagctatacatgaacaacatataatttatcctcaacctaaaggcgatggaaatattcatcttcttctacttgcttgttgtgatagttttccatttatcagcaacgattatgacaaattcgttaaccctagttctgaacaaattaaacttttgaaacttttctggaaatgttgttatttctatggttacatgcttagttacactcccgtaggaatgcaagaagcaagagattatatgagtctttctatgattattattcgacaacttcaaatgtattataatgatgaagaatatatgaataattacggacgaactttagatcatctagcttatgtaataagtcaatcagacatgcacaaccctgacgtactatctattgcatataatttttattcagaagcattagagtatagacaaaagctcgtaacaaaacatccggctaatatggaataccaaagaaatcttgcatggacaatggataatttaggtgtgtttttgacagacttccttacagaagatgaatatatcagtaatcataaagacttctatctgaatcccagttgttttgagacaggtgaaaatcacccagaagttaagcaacgaacagaatttctcaaaaaaaatttacaagatgcagaaaccttacttcaggaatctctacaaatcagaaaaatggtagcatcaaaaaatggtaatcataatagtactgaagttgcttggacggatgttagcatgaccaaattgcttatgaattatagcgataaactagatgaagcagagcaatatattttagatgcattaaacatatataatgaacttgataaattatatcctgcgcaacatgcatcaagccaggcaaaagcatataaaatatatagtgaactattaaaatgcatgaataaaccagacgatgcagcaaatgcatataagacgagactgtaattaattctgtgtaaactctaaaagagctatatatcctcttgggttgatgttaaaataaatatcaattcaggaggattttttatggcacgaagaagaaaaatggatccagaacgcaa

SEQ ID NO: 475 - DNA, 10897 bp, Eubacterium hallii
gtatccacagctatccggatcaaaacgcttcactgccagttcatttcccgctgccgtaagctcctgattcaactctgtcataacttcattatcaataatgattcttcgggcatcaatctgttcttccgggattcccatggcactccaaaaatataaataagatacgtctgttttataggaaaatacttcattcagcgccggggactgaaatcgcactccatcggttcttaaaagaaatcctgcatcttcattcgaaatgttccgaaaacagtaaggacatttcttcactcgtattgtttttgtctcctgcattagtatctctcccgtctaacatctctttgttgcttttatcgaaatctcatgtttcgattccaaaataatataatacgtcacatcctgttttatgacagctttctttgtagaaatcccctgatctcttgaaagaccggcttccctgatttcaaaaggctgctgcttagaaacaattatcagttcttccggctgatctgatgcacagatttccaacccctgatcttcgatataataagtaaattctttacctgacggatgcttaccatacataagaatattatcaagtgcaactttatcttttcgaatcgttccatctgcacaaacagccgcacatcctccaaaagcagaaccatgtgtgatcagaaaatccatcccaaatacacgatctctctgcttcttttcttcttcctgttttaactgccgctcctcttctcttctctgactctccagttcagaaacctgaccagcataatccaatatgtatttttccttctgctgccttccgctctgtcgcttccattgaacgacacctgccacagctaataccgctgcgatcacaagaccggcttccatagtaaaagtagcaatcaactctttacacctcattcaatccttgtttattgacagaaatttcctctttgtatttctatcttgcatgatatcacgaattactccatagctaacgctactgacatcatcctgtatacgattatagcagaaaaaaagcatttctcaaagagggtgatttattggtttttacttgcagtctctatttgatttctatctgaaaatattataagatataattatggaaaactatatagatttttgtaaataacagaaatgaggatttttttatgtctcctgaatcattgcaattgaaaaaagaatttgaaatacaaaagatagcttctcttcattattttgaatataaaagcgatttcatttttaaaagtgaatatcatgactactggaaattactttatgtcgaagatggaagcgctgaaattacattttctaataaaaagctttctccagtaattttagaaaagggagatttatttatacaatctcctgatgaatattattcctttaaagcagcaccagggaaaatcgctgtcctttttacagctggcttttattgcgacacccaacatcctgctcttctttctaatctttccaacaaaaagtttcactgccagaaaaaagaagcaaccctattacaggaccttgctctagaagggaaaaataatttttctcctaaaattaacccggtatctcctgccgcccttgaacgaagatataatcaaccatttggtggagaacagctaatcagtatttatcttgaaatgcttcttatcagccttatgcgccagtatacttcttccgaagaacaaaaagattcaaaaaaaaatatggatcaacctgaaaaagaaaacaatctttctccggccctcctgaaaacagactctattctttttaatcgaattactgattattatgaagcacatatcacggaacatattaaagtagaacacctttgtaaagaatttgcgatcggacgctcccatttacaaagaatattcagagaacagaccggttatggtgccatagaatacttctgccagatgaggatcagtgtcgcgaaacgctgtattcgtgaaaacaaaatgaacctgaccgataccgcagccgcacttggctatacctccatctattatttttcaaaacaatttaaaaaaattaccggtatgtctccttctcaatatcaaaagatggtacgctcctctaaaaaagatccgatttatgaacagatagatttggagaatccactttctccatctgatataaaatattaattttttcaaattaaaaattcaagaatgcctcagcattcttgaatttttcttctactctttatcgtccctgcaggtgaaccgtctattccatccgtctatttccataaattttccggataagttccctgtactttcatggcagcaatcgcatccataaccgacttcttatcttctttgtaagtaactccataccacttttcttcagattccattacctctacagtagctttcttttcctgaagtaattcttccactacgcttggaaggaaatactcacacttcataggattctcttttaaacctttatctaagaacgcagggaatttttcttcaagtacttttaaaaatcccggtgtaaatccccagcagttcatagaaactggtgttttatccggaaccggtatccagcttgctccgtcatccaatgtataagctgcttcttctcctcgtttttcgattcttgttctttctgtaatttcttttaagaaatgattttcatcaacctgacatacccctcttgatacatgaccattctcagtaattgttttctctatatggaaggcaatcataacataacgatacagctcatcatcttcatgcgttgtcagataatcatataacatctgaaatgcctttggtccataataatcatctgcattgatcaccgcaaatggtgcatctacaacatccttacagcacagtagtgcatgacctgtcccaaatggtttttctcttccttccggtacgtgatatccttccggcagcttatcaagttcctggaaaacatattctacttccataaatggttcgattcttttaccgacgatttctttaaaatctttctcaatcgcatgcttaataataaaaacaactttcttaaaaccagcacgttttgcatcatacacactgaagtctaaaatagcatgtccctgcacatctactggatccatctgctttaaaccgccataacgacttcccattcctgctgccattacaattaatacaggttctttcattctctcttcctccctatgtaaaaaatcttctttatttattgaaatcttcttttctattttcccatagaaaatcaaaaacatcaatgatgattttatactatttttataattattatgtatttatctcaaatatttatatttctttcgttgagaacactaaaaaaagacaatataatataataaataacatttgatatttttatcacaatcatccactacaagtatcccatagaaatacagtctatcatgtactctaggaatctttttgtgcttgcttttgtgagaaagactccgagagtacatacaaatccaaaggaggcagttatgacgcaaacaagatatactttgcaacaacaccatattaacttaaagtcatctgtaaaattgtcacaaatcaatatgtatcattgcgaatcccctgcttcaaacatctttccggggcatccatattctaaaatcatctttattcaaaaaggtgacggacaattttattttggcaatcaatttttaccagttcaggaaaatgatttattattggtgaatcccgataaacaaaagttttccgttgatgtacaaaaccctccacttgattttattattttaggtattgaaaatcttctttttactaacgataccggtgaagcgatttctccgtttacaagactttctctttcttccgatatttgccttaatctcatgcatatgctcattcatgaagtaaataatcgttcagaatactatgaagaggcatgtcggcattatctgaatcttattcttatagaaatacaacggaatacacaaattaattatgattatccttcaaaagaaaaaaataatagagattgtacttttgttaaagagtatttagatgaccattttactgaaaacattactcttgatcttctttccaaagaaagcaaaatgaataaatattatctggtacactcttttacaaagcattttggatgttctccgattagctatctgaatgaaaaacgaatcgaggaaagtaaaaatcttctggaaacaacaaatcattcaatcgcatccattgcatctatgatcggtttttcctcacaatcttacttttctcaatcattcaagaaaaatacatttatgactccaaacgaatatcgaagagccgcacggcaaatttaatattttttgttattattttttatgtttcatctggaaaaagagtctaacttatagtataatggtataattaatgcaaaaacagtatctaatataggaggattttatccatgccagtaaaatatgtattcgtcacaggtggagttgtttccggtttaggaaagggtattaccgcagcttctcttggacgtcttttaaaagcacgtggttataaagtaaccagccagaagtttgacccatatatcaatatggatccaggtacaatgaacccgatacagcacggtgaagtttttgttaccgatgacggtgcggaaacagaccttgaccttggacattatgaacgtttcattgatgaaaagttaaataaacagtctaatgttactaccggtaaagtatactggagtatccttaacaaagaacgtcgtggagatttcggcggacataccgtacaggttattcctcatgtcactaatgaaattaagagtcgtttttatcataatgaagatgcttctgaaacagaagtagcaattattgagattggtggaactgccggtgatatcgaaagtcagccatttttagaagcgcttcgtcagttccagcatgaagtaggacatgagaactgtattcttattcatgtaacactgattccttacttaaaagcttccggagaattaaagaccaagcctacacaggccagtgtaaaagaattgcagggaatgggaattcagccagatattcttgtttgtcgttctgaccttccattagatgatgatattaaagcaaaaatcgctcagttctgtaatgttcctaagaaacgtgttattcagaatcttgatgtcgatattttatatgaattacctcttgctatggaaaaagaaaaacttgctaacgtagcatgtgaatgtctgaatatggaatgcccacagcctgatttatctgattggatctctatggttgatgcctggaaacatccaaaacataaagttaaagttgctctcgttggtaaatacgtttctctccacgatgcttacatcagtgttgtagaagcattaaaacatggagcagttgccaacaacgcagaagttgaaatcaagtgggttgattccgaactggtaagcaactacaacgtagatagtttcttctctgacgtagacggcatcatcgttcctggtggatttggtgacagaggtatcgaaggtatgatctgttcaatccaatatgcccgcgaacataagattccgtatcttggactttgtctcggaatgcagcttactatcgtagaatttgctcgtaatgttctcggattaaaagatgcacacagtcatgaatttaatgaaaacacagcgaatcctgtcatccatatcatgcctgataaagaaggcatcactgatttaggcggaacacttcgtcttggttcttatccatgtatccttgacgaacactccaaagcatatcagctttatggtcataaacagattgaagaaagacatcgtcatcgttacgaagtaaataatgattaccgcgaagtactccaggaaaatggaatgcttctttccggattctcacctgacggacgtatcgttgaaatggtagagattcctgaacatccttggtttatcggaacacaggcacatcctgaatttaaatcaagaccgaataaaccacacccattatttaagggattccttgctgcttcattagcacatcagaataaataataaaaatggtgtcacaggaacggtttaatgaccgtagcctgtggcaccatttttatctcagtcgaaaagactcccacctctttcaggtggtgagtgacagcaaatttgtctcagtaggagtccaatctccgactgagataaacgctccgcgaggatgcgcagtgattctgtaaagaatatgtcagcttacgctgaccagaatcacgcgccaagtctcgcagcggctcgacttgaatttaaattaaggctgtttatcatattaaaatttcatataatattgtgatgagaatacaaagtccacttcctgcaaaaaataaagcattcggtttccatttttcagagattgcaggaataaccgtttttttagctgtttgaatccttgtttcttttttctcttttgttttgtatacttccttttcctctttttcttcttttccaataagaaataccagatatcctgctatcagcatactaactactgctataactccaccaataagcacgaggcttatttcaattcctccctgcatatttgtaacacctggattaaaaagatgatagcctgcaatattacactctaacaaggtccgtataactttggttgaaggaaaacaacataggattacagtaaatgcattaaacaacatatgaagtgctatcgaaacggtcagattatctgtaatataaattacaacagcaaaaaacagccccataacaaatgcataacacatctgattaaaattcatatgaagtaaagcaaatgttatagcagatataaatattgctatcttcttatctgaaattccacgataaataattcctctaaaaagaacttcttctatcaaggctggcatgatcgccactgcgatcattgcttctagtggatgccctgaaatttcttctaaagaaacatctaataagttctgaaatacgatcatagaacaggcatttacatagcctgccataacaaacagaactatagcagcaataacaataaaaaaagtactttttaaagaaaccttttttaaatgacaatattctgttggttttacataagcttttttgcaacaccaacatacataaagcagcaatatttcattaagtaatacggttccctgaaaacttatattaagggaatgcatcgtaaaaattgttataagccagcctgttatacaaatcccaatattttttagatttctttcccatatatttgcaagcaaaaaccaaattcctgttgtcgctatcactatgccaaatgggaaaattcccagtaaggatacaagaaccgaccctattatatgcagcagcactatcataaaccatattttattaggatttaaaaaagagttttctaacatttctgttcctccatatggaatggcacttctgctatttttcaattaacgtaattccggtattgcttatctttatctttttatctttgtataaacggccaatcgcacgtttaaactcattcttactcatgccaaattcacttcggatatcttctggagcagacttatcatgatatggaagagcaccatcattctcctgaagtttttccataatctttgcagaatcaacatccatctgtaaatgtgccttttcacgaaggctgaggtttagtttaccgtcttctcttacagaaagaactcttgcctgtaccgtctctcctattcttaactttctaacaatttctttattctgaagcataccattatacttattatctacagcaacaaatactccatactccggattctttccatatacagttccctgtacaatatcatctgctttatatggagaatctgtacgaaggaaatcatataccttcattgttgcacaaagtcggtcactcttatcaatatagagtcctactaaatacttatctcctttttgaacctttacaatctgttcactatatggaagaagaagatctttctccaatccccagtacataaaaccgccaatattatttacctgcgctacttctaaaacggcaagttctcctaactgaagctttggcatgtttgttgtcgcaatttctctgtcttttgaatcacgatacacaaatacctctacttcatcaccaatctttgcattctgtggaacctgctttttcggaagtaaaacacaatcactttttccattcctctctggagtatcagaaagatacactccaaaatctgttttatgatcaatatataacttctgttttacgcctaattctatcattacaaatcctccctttattatactattatttttcttcctgtttctgcaatatcatctcaactaatgctgcaacttccccatcaggttttatatattttactttaaaaatattttcctgctgttgtgtaaatacctgtatcgtttccttaaacatcgctgcttttcgatagtcaattcgcacttcacttacatttacattctcaggaagtatatcttctgaccataatgcatacaccgtattattcacatgattattactgtctaaatattgctttgttacttcgatagattcctgctgtttccactcaccgttatcatctatctttcgattaattcttacggtagtatccacatccttttctacgtaaatatccgcaatttctttgcttactttcatcggaagcatctttttcgtatccatcaatatccagatagcttctgctaaaacaatcgcttcaccctcttcgtcaagaatagagtatcttctgtatccataaaatcctcgcatcttatatgcctgtgtcgtaaccgtaatgtgctcagacatcttaggatgtcttattatctttacattccatgcaattaaataccatgctctatgattcttctgatcttcttctactccaagtcctaactcttctgactgaaacattccacaatcctgaaaatattctaaaatctgatggagtcttgctactccactttggtctacctcactatagcggacctgtattttcatttcatacatataatgcaccttttacttttcttctacttctaaaaattaatgcgtcttttctcactgtcctttattccttctacttttctggcagtgccgtattatcataacatatttttagtactttttcatcttctttctcaatttcaaaagcaagttcacaggtagccatatcgataaactttttcactaatacaacatctactacttcatagtctcctactatcgcttctttacaggcattctttttctttgctctatatgaaaaactcacatcctcactacaggttgtcatatccggcagccatcctttacaggaactgtgtatttgctttacatctgttttcctaataaaatcctgtacattctgtgcattaagtccacttcctgccaaaatctcaatttgctctccatattctttctgtaaatactgtatagtctctgctccggcaatcgctgtagactttaatccactagtaagaactctgtccactccaatctcaataagcgtttgcattgcctcatttatatccgtcacacaatcaaatgccctgtgaaaaacagactccttattataagacttaataagctgtaccattttctttgtttgcttctcatttatttttcgatcagcagtcaaacagccaaatgcaatcccatccgctccattttccaataaaatgtgggcatcctccaacatcacttcaaaatcttccatattatagcaaaaacctgctcctcttggacgaaccatacaaataaccttcaaacctgtatttttctttacctgacgaagtgttccaagagacggggttaagccacctaaatgcaatgcactatttaactctactctcttcgctccacccttccaggcctgcaatgtatcataataactaccacagcagatttctacttctagattctttgacataaatctaatctccttcttttttacatttttgttcctctaactccagccactgtcagccctgaaatagaaaagctatcttatatttgtgccttagagcgaggattgaatgcgagacgttaagcgaacattcaacccacagtgatagaatcacaaatataagatagcttttctatttcgaggcatcagcctgttaatgaactaaatagtaaaaactatagtaaaaactaaatcaaacgatttttcttttctttttcctctctcatcaacgttttcattgctgtttctactgccgtcgtttcaccaaagaaagctaatgttgtgatatgctgtggacaacttccattaatctctaccggataaacattacttgtcttaaatgcacgatctgcgtaatataatacaccggctaccgttgtctgtaataaacctactgcatcaaactttctactttttaattcttctctgctctccgcattcattttgcgataaaacatcttcattacggattcacttggattataaataatacgtccttctgtcattttaaacctccactacatcttgtacatattctagagcatgtttatataatcattaattatcatgatagcatactcctaatcaagtaacaatgtactttcttgctgttaatatgtaatatcttcccaatatgcaaaaaaaggacacaataatgtgtcctatccattacagcgctaccaggattcgaacctggaaatgctggaatcagaatccagtgccttaccatttggcgatagcgctacattgtgattctaaaagaatcaaacgtgggcaagaggattcgaacccccgaccttttggtccgtagccaaacgctctatccagctgagctatgcccacaaattctttaaagtatgccggcgatcggaatcgaaccgatacgggagtat

SEQ ID NO: 476 - DNA, 10740 bp, Eubacterium hallii
tgtcagatcgaggtccagaaccactggttcttttcctgtctttactgtttatttaggttttgaactttcgttctgttccatggacttccctgcagacatcactctcaggaaaacccgaatgaaattttgaatcgacgttcaaggttgttttgttattcagttatcaaggttttgtgttttctttcgaaaacgcttaattatattatcacatcttcaagttcttgtcaagaacttttttcaagaactttttctcctttttaagaagttcgttctctctgtcaaatgtgaacttttatattttatcacacaatctctaatctgtcaagaagttttttaactttcttttaagattcttttcattttcctaagaaaaatgggtttctcgtgtgcaacggatattataatatcacaacagtatatatgagtcaagctttttttgaataaattttatttttcttaaaaaacgttgtatactgtactttttttgtatttttctttccctgtgtgttcttttgcttcgatatattgttatttttttatcattttattcaaaaaatgccacctatttttgctttttatttggaaaatatgccaaaaaaaggaagtcgaaacatgacttcctttttttatttgctttattcttcttctgtttttgtaagatttggtttttctacagctgcaattgcatctttctgcattggaattctgcagttacggttattaccaaactcaacgataacggtgtcatccataatatcaataatcacaccatagaatccacttgttgttaatacgctatctccagcctgcattcctgcatgcatctcgtctgctgccttctgctgttttttctgtggacgaattgtcataaagtaaatgattgctccaaacagaattacatatgcaacaatcatagtgatagatgagcctgcgctcgcactctgtgctaataacatgtctttacctccattattcttttataaatatgatgttggaatcaaaaaatattttgaccccttgataccagattgcatcggctttctgaccttttgaccctgatatcataaatatattaccggtattcttcttccggtgtcaaaaaaccttctaatgtggtttttttgaactccttatatcgatgtgcctcaatcgctccgcgtatttcttccattaaatgattatagaaatataaattatgcagaacacaaaggcgcattccaagcatttcctttgcttttagcaaatgccgaatatacgctctgctatatgtccggcaagctggacactggcatccttcttcaattggccgaggatctaattcaaacttcttattaaaaaggtttaattttccatgatgtgtgtatacatgaccatgccttccatttcgagaaggatatacacaatcaaaaaagtcaacccctctgtcaactgcctctatgatatttgccggagttcctactcccataagatacgtaggcttttcttctggcagatatggtacaacttcatctaaaatgtggtacatttcttcatgtgtctcacctactgcaagaccacctatcgcatatccatctaagtctaattctctgattctcttagcatgttctacacgtatatctgcaaatataccaccctgattaattccaaaaagcatctgatgaggattcaccgtgtctggaagactatttaactccttcatctttatcttgcatcgctctaaccatctcgtcgttctgtctacagaattctggatataagttctgtctgcacgacttgatggacattcatcaaaggccatggcaatcgtcgaaccaaggtttgattgaatctgcatactttcttctggacccataaaaatgtgatgaccatcaatatgtgactgaaaatataccccttcttcttttatcttacgaagaccggacaatgaaaacacctgaaatccaccggaatcggtaagaatcggtttatcccagcccataaatttatgaagaccgccaaattctttaatcaacttgtcccctgttcttacatgcaaatgatacgtatttgataattctacctgtgttccaattgtgcgaagatcatctgtgctgacagcccccttgattgctcctactgttcctacattcataaaaacaggagtctgtatcgtaccatggactgtctcaaactctccccgtttagccataccatctttcgttaataacttatacatatactctccttaactttacacataaatttgattttatcataaacaaagcaaatgtacaacctttatccttactttttatcacttctataaaagtttttcacaccttcaagactgcttcccatattttgaagcagcagatcaagtacagttactgcagccatagtttccaccactactacagctcttggaacaataatcgggtcatgtcgtccatgaattacaatctccgtatcttctccctctcggtttacggtctgctgtggctgcgcaatcgatggagttggtttaaatgccgcacgaaatgtaatcacagagccatcactcattccaccaagtatcccgcctgcatgattcgttttcttttcaatctttccattatgattataaaaatcatcattattttcagaaccaacactttgcgccgctgcaaatccatctccaatttcaaaaccttttactgctccaatagataaaattgctttgccaagatttgcacttaatttatcaaatactggttctccaattcctaccggcattcctgtaatcacgcactctacaataccgccactagaatccagttccctcatcttctcctgaagataggcttctgcctgtgctgctgcctgtacatcaggcatatataaagcatttttatctctttcttcttttgaaaatctgctgctgtcaatctgaactggtcctactgcctttgtataagcaaatatttcgattcctaactcttctaacacttttgctgccactgcaccagctgctactctagccgttgtctctcttcctgaagaacgtccaccaccgcggtaatcacgaaaaccatatttcttatcaaatgtataatctgcatgtcctggacgatatacatctttaattgccgaataatcttttgaatgctgatctttattgaacactgccatcgaaattggtgttcctgttgtctttccttcaaaaacacctgataaaatctctacctgatcatcttcttttcgctttgttgtatactttgactgcccaggctttcttctatttagatatttctgtacatcttcttcgcaaagagaaagacctgccggacagccgtccactacaacaccaactccctttccatgtgtctctccccatgttgtcatacggaacaatgtccctaatgttgaacctgccatatattcctcctgctaaaatcacataattaattgtccttaatattactcactcttttttattattttatactgcaaatactattcttgattccactctttataagccttcatactttatccgtttattcttcttctaacataaacattagtacagaaagtaatgccattccggcagtttcagtacgcaaaatccgatggccaagtgtaatcggttctgcaccggcttccatagcaagagaaacctcctcctctggaaatccaccttccggtccaatatatattcccaaactctttttaccctttacggattctactacttgtcttgaatgtacgattccttctgcatcctcataaggaatcagtaacatatccatactttttccatactctaccgcttccttaaacgacattactgactttacttctggaatcattcctcttttcgactgtttcgctgcactttttgcaatctcattccaacgctgtactttttttgctgccttctttgcatcaagcttcacaactgctcttttcgtagccatcggcacaatccccgtaacaccaagctctactgctttttgaataatcagctccattttatcgtttttgggaagtccctgaaaaagcgtaatctttacaggaagttcccgagattctccattaatatcaacaataactgcctttacaatatctgactgcatatcctctatgctgcaaatatattcctttcccttttcctcacagcaaagagaaatcttctctccctttttcatccgaagcacattacgaatatgattcacatcctgtaaatctgtaatccagacttccttttctttaacactagcaggctgtataaaaaactgatacataaattcctccgttccattctctgcctttttaagacatgcatatatcataacttctttcaaaaaatatgtcaatttactatttgattcattaagaagaaaaacagacgaaaataaaactattagcccatagccactgtaaagatatcactgcgtagaaaatgcctgttcggcatttttacttgctctcacattacattggctatgggctaatagttttattttctacttgttggctccagaaggaatgaatgcaatagtttttgatgagagaaggaggagaggtcaggagtctgctacttactctctccgctatgctgacttttttcaagtttcactgatgataagatgatactgcaagctatcactatacatgataaatttatcattatattgtcgcgatatatcgtttgtctcgatgtatgtcatgcgttacatgatgcacatttcgtagcaagaataccgaggtattcttgaattagagtatacaatgaatctaaaggggactcctctaattttttggaaaacgacaatgccctctctctttactgttcgttaaaaaaagcacctaagcttctgacgatacatcttccgagcaagcagtagtcttctaatttttcccccatctctctccaaagactattgcattcattccttctggagccaacacacagaaaaaagaaataataccatatcccagatgcggcttcggagcgtgtttaagatgcggataagcatcttaaacacagcgactacagagcagatgggatatggtattatttcttttttcgtttgttttctctaatgaattaaatagttatcttccactttttattactttttttaatgtgaggttctgatcaaggagaaggatatctgcttttttcccaacactgattgaacctctttcttcatagattccaagactgatggcaggattttttgtagcacaggctacggctgtttccagcggaattcccatctgtgtaactgctgttcgcatgcagtctgcaagatttgttacagaacctgctaatgccccatcagaaacgagagttgctctgttccctgttacttttacatccagtcctcctaatgtatactgtccatctggcatccccgttgctctcatactatcactgataaatatcatacgttccgcacccatcattttaaatgctgctcttatcatagatggatggatatgcactccgtcacaaatgatttcggacatggcatgttcattgtcagatgctgcaccgacaactcctggttctctatgtgtaaaaccagtcattgcattaaataaatgtactacatgatttgctcccgcttccaatgcttcctttgctgtttcataagatgcattggtatgtgctaatgaaatatttactttatctttcatgttcttgataaaagaaactgcgtttgcactttcttctggtgcaatccccagaaatttaacgagatgatctgatgcatctaaaaatctctgagcaatttcttcattacaagggataatattccgttcatcctgtgcaccttttttaattggactgataaatggtccttccatattaataccaacaaagtccgctctctttttatcgttctttgtttctatctgattgatattttcacattcttttttatattctgccgctgtttttaaaattctctccagttcttctaccggaagagtcattgtagctggagcaattgcagtaacaccaacgcttgcttcgtactctgcaatacggcgaatcgcttctttgtctccatcacaaaagtcatcccccatacatccatggaaatgcagatcaattaatcccggaatggcataagctccctttccatctattacattctctgtcagtttttctttctgcacagaggaatctgctgtcatattcattttttttaatgtaacttctttttccttttcggtatacacagctgtaatagtatctccctgtgtgataataccacctaaaatgaattccccggattctgtatatacctttacattatcaattatcatagttataatctcctcactttctttcgattttttctgcataagatttttccaaagcctgtaatgtccgttcatgcaatatttttttctttgtttcatctcgctctacataataagaataaataatatctgtcatgattagaatcggaaattgtggcgaaattacatttccatgatttaaatgaagtaaagacggaactaatacaacttccgtacaaaactctttataatcatctctgttgttcgcagtaaataagattgttttagctcctcgctttttcgcttcttttaaaagaaaaataatttcttctttttgcccaccgatactaaatccaaaaacaaggctatcctcatcctgaaacacagcccgcatacgcatcagatcagtatctgtaatcgagtccacatctgcaccaatacgcataaaacgaatttccatttcttttgcagcaagacctgaacttcctttcccacataccagaactttctttgctttattcagataatttccaattctttcaatctgtttttcatccacaaggctatatgaagaatttaaaagttcctgataagcattcagtatcatcaatgtgttgcctgccatcgtttcctttttctctacaaaattcttctcatactgataaataaattcccgatatccacgatatccacatttctgcgcaaatcgggaaagagaagcttccgaaacaaaaagtttcgatgctactgtctttgctgaaaaatctgcctttttctgattatttataaagaaatcagcaatcgatttctcaactgttgtaaacttattataattagactctataaccggaataactgatttaaaataatgattcattgtttactttccaatcacttccacaaaagacttcgtaataagctgtggtcttgtgataatcgacccaacaacaacactatatgctcccagctccaaaactctttttgctttttctggtgtattgatattcccttctgcaatgaccttatgttttactttagaaacaattgttctcaaaatctcaaaatcattttcttcaatcttatctccctcactctgctttgtataaccgaccatggttgttccgataaaatcaaaaccaagtgcatctgcgtgaaccgcttcttctacagtagagcaatctgccataaaaagctggttaggatattttttctttacttcgtgaaaaaactcatctaacgtcttcccttccggtcttgtagaactcgttgcatccatcgctataatctccggctttacttccatcagctcatcaacttctttcatcgtaggggtaatataaatttcgctatcctcgtaatccctttttacaatgcctatgatcggaagttctacctgcgtctggatttctttaatgtcttcctttgtatttgcacgaataccactagctccaccaacttttgctgctaatgccattctccccataataaaagaagaatgtagaggttcctcaggaagagcctgacaggatacaattaattttccttttaaatttttaatcttttcttttatattcataatctttaatctattcctttcctacttcattctagcctcgttattcataatttcttttattggaaacttctaatgtattttctaaacatatttttattggtaatttctattggcaatttctttcctggcttcgtatttgttatttattaagtaaaaaatattatttcccgcttagtataatccttttcaaaattattttcaaatatttttattatttctgaaagtactttcaaccacgattcttttttgtaattcttcttatcaaaaactgaaagtagcttccatatatttttattctattgctttttacttttttctaggtatactaaagacacaaataagaacaaattttaaggagagtatactattatgagaatttgtagagcaacagattataacgatatgagcagaaaggcagctcagattattttggcacagattattatgaaaccaaattgtgtccttggtttagctaccggttcttctccaataggaacttacgagcagttaatcgaatggtataataaagacgagcttgatttttctgaagtaactagtatcaaccttgatgaatataaaggattaagtccagaagacccgcaaagttaccgctacttcatgaacacacatttatttgatcatgtcaatatcgataaaaatcgtacttttgttccagacggactcgccacagattcggaaaagtcctgcgctgagtacaatgcgaatattcttaagcagggtggtattgatctgcagctcctcggaatcggaagaaacggacacatcggctttaatgagccaggtacagtatttaagaaagaaacacactgtgtagatcttacagaaagtacaattgaggcaaacaaacgtttctttgattccgaagctgatgttccacgccaggcatattctttaggaattaaaaatatcatgcaggcaagaaagattcttgttgttgcaagtggagaagataaggcagatgctttatataatgccattcatggcgaaattactcctgaagtaccagcctcaattctgcagcttcataatgatgtaactatcgtagctgatgaagcagcattaaaaagattttaattgttatagagcctgattgaaaaaaacactacgagatagctttgatctgtacctaggattctagatacagatcactttcgcaagctatctcgtagcgttttttctaatcaatctgatcaaaatttaatttaatgcaaaatctccatcaaaataattaatcttcattgcttcacgtacatcattcaatgtctcggctgctttcttttcagcaactttggagccttcgtgtaaaatatcatatacatccggaatacgctgttcccacatctttcttctctcacgaatcggtccaagttccgcttctaatactttatttaagaacttcttcaccttaacatcaccaagtccacctctttgataatgttctttcaactcatcaaggttctggtaaccaggaaggaattctgcgaaatattcatctttgcaaaatgcatctaaataaataaataccggattgccttctacctgaccaggatcttctacacgaaggtgatttggatctgtaaacatagacataacctttttctttactacgtctgcttcatcagaaagataaatacagtttccaagtgacttactcatctttgcctttccatcaatgccaggaagacgaagacaggctttattagatgggagaacgatctgtggatctgttagcgtctctccatacacactattaaacttatgaacgatttctttacactgttcgatcatcggcatctgatcttctcctacaggaactgtagtcgcacgaaaagcagtaatatctgctgcctgactgatcggataacagaagaatcctacaggaatactcgcttcaaagtttctcatcttaatctcagacttaacagttggatttctctgtacgcgggcaactgtaacaaggttcatataatagaaagtaagctctgtaagctcaggaaccatggactgaatgaaaatcgttgacttttccggatcaataccacatgctagataatctaatgctacctgaataatattctgacgtactttttccggatgttctgcattatctgtaagtgcctgcgcatctgcaatcatgatataaatttcatcatagtctccggaattctgtaatctgactctctctgataatgagcctacatagtgtcctacatgaagacgacccgttggacggtctccagttaaaattacttttttcattatatagtttctccttcatatatttatctgctcttgaaatctttctgtgcttcattcggcagggaaagactccaagagaaaactagtcttcatcaagtttcaatacactcataaatgcctgctgtggtatctctacattaccaacctgacgcattctcttcttaccttctttctgcttttcaagaagcttcttcttacgggaaatatcaccgccataacatttggcaagtacatctttacggacagcctttactgtttcacgggcaataatcttgcttccgattgctgcctgtattggaacttcaaataaatgtcttgggatttcttcttttaacttttcacaaatctttcttgctcgctcatacgctgtagaggagtgaacaataaaggaaagtgcatcgactgtctcacgattaatgaggatatctaacttcacaagttctgaacgctggtatcctttcatctcataatcaaacgaagcatatcctctggaacgggattttaatgcatcaaagaaatcataaataatttcattaagtggcagttcatatttcaaaagcgctctggtttcttccatatattccatggaaatatatgtgcctcggcgt

SEQ ID NO: 477 - DNA, 10667 bp, Eubacterium hallii
cttgtctatgtagaagatcaggaagattttaatacagaatttcttaccagtaaacttttggagcactatccggaccgcgttattatagaatataacggtatgtggaccattgatcatatggtagaagcattggaaggaactccacttatgatattccagacaatcgtaagtgctaatgcggaaacatttgatttatatatgaacaatatgcgttcccttgctgtagaaatgtttaagatggcagaattggttattattaaccgctgtacgaaggcaacaccaagagcaacttacagaagaagcatcaaagcagtaaaccgtagtgttcaggttgtttttgattcaatggtcccaggtgaagacatgggagaagaagaggaagagttaccatttgatatcagcggagatgagattcatcttgaagatgatgattatggagtatggtttattgatgccatggaacgtcctgaactctatgacggaaagactatggtaatgaaaacaagggtatttaaagcaatgcgtatgccaaagggaactttcgttccaggacgacatgcgatgacctgttgtgctgatgatattcagttcattggatatctttgccatacaaaccatgcgaagtcctctacaattaaatctcttaagaataagatgtggattacacttaccgcagaagtaaaagtagaatataacgaagaatataaagataaagggccggtactatacgccaaacgaattgaagcagcagaaccgccagaagaagaattagtatatttttaaatactaatttgagggagtaaagaaacgaaaagcagaaatttaatagaaaagaaaatgtgaagatagtcgcttcgcagaaaatgcctgctcggcatttttactcgcttcgacatcacattttcttttctattaaatttctgcttttctgtgctttggctccagatgaaaattagtatttaaatcttagatgggaataaggggattgcccagaaggctatggtcagaattccgtagcgcaacggaacaaaatcaaacttatttatccttttacagcaagaagactccgacctctaaggtgggaggtgaattgcgtctgttacctacttgatagagcgttctaatcatagtataatatctttagtcaaataataaaaattaaaatacaataaattgagataataacgcacatttagtactcttactatactagcatcgtgtgcttgtggtcaagtatcgcaggcggtttttcgaggaaaaggaagtgttggaatggcaaacagagcatataaattcagaatgtatcccaatgatgaacagaagattttgtttgccagaacttttggttgtgtgagaatggtatacaatcattggcttgatagaaagatccggcagtatgaggagaacaagaccaatgtaacatataccatttgtgccaaagaaatggctgcaatgaagaaaacggaagaatacggatttttaaaggaagtagatagtattgcattacagcaatcgctcagacaccttgatacggcatttcagaactttttcaaacagccgaaaacaggtttcccaaggtttaaatcaaaaaagcggaataaaaacagctattctacggtctgcatcaatgggaacataacgctgtctaatggatatttgaaattacctaagattggacaagtccggttaaaacagcacaggattatcccagaggaatacagactaaaatctgtaacagtaattcagacaccaagcggaaaatactatgcaagtatcctttttgagtatgaagatcaagtacaggaaaaggaaatgcaaaagtttttaggtttggatttttctatgcgtgaattgtatcgtgacagcaatggtaaggagcctgcctatccgaggtattacaggaacgtagagaaaaaattagcgagagaacaacgtaagctttccaaaatgcagaaaggttcaaacaatcgcaataagcagagaattaaggtggcaaaacttcacgaaaaggtttccaatcaacgaaaagattttttacatacacaatcaagacagataaccaatgcttatgattgtgtatgtatagaagatttagatatgaaagcaatgtcgcggtcgctaaatttggggaaatctgtttcggataacggctggggaatgttcacaacatttttgaaatacaaactggaggaacaggggaaaaggcttgtgagagtggatagattttttgcaagcagccagacctgttctgtttgtggttacaaaaatgcaaaaacgaaaaatcttgcgataagagagtgggattgtccgcagtgcggaacccatcatgacagagatataaatgcggcggtaaatattagaaatgagggaatgcggctggtaaatgcatgaccttaacacaataataacacaaccgtgggacacacggggatagctcgcttatgcttagcacagtagtgttatcgaacgagaaccaaacttgccgaggttgggaagcccccacctctataggtggggaggatgtcacaataatattatgtgggtatgctataaaataatattttacagattctgaaaagaaatgataaaagagtatatccaagataagaaatgtgttctaagattttttctgtgttcatatttatagaaaatattacaagagtacataataagaaaacaggaggaaaggcttttagagtgtccggtggagacagagatactgttgatgcaatgggcaagtagaagaaagttgtaaaagcatgaaggaaaagtcagtaaaaagtaatgggaaagacagcagggagtcgtttaacagtcggtggggatttattcttgcctgtatcggttcggcagtaggaatgggaaatatatggatgttttctactagagtttctctctatggtggaggttcatttttaattccgtattttatttttgttatcttgatcggatcaactggtgttataggagagatgagtcttggacgagctgcaagatccggaccgattgatgcctttggtatgatttgtgaacagaagggaaaaaggaagatcggggaggctcttggaatgattccggtgcttggatctcttgcaatggcaattggttatacagtagttatgggttggattttaaagtatgctgttggtacatttacaggagcaacgcttgctccggaaagtatagaagattttggcggacgttttggaagtatggcatctgcatttggtaataacctgtggcagattggtgcgttgatcatatgcatggctattttgatgttcggtgtaggaaggggaatcgaaaaggcaaataaaatattgatgccggtattttttatattgtttgttattcttggcatatatgtgttttttcagccgggagctgctgcaggatatcattatatttttcgtgtagataaagcagcgttattaagtccaaaaacatggatatttgcgcttgggcaggcatttttctctctttctgttgcgggaaatggaacgttgatctatggttcctatctttctgatgaagaagatattccggcatcggcagaaagagttgcattttttgatacagtagcagcgatgcttgcagcacttgttattattcctgcgatggcaacgacaggggcgcagcttaatcagggaggtcctggtctgctctttatttatttaccgaatcttataaaatcaatgccgggaagtacattgatcgcaatgattttctttgtagcggtgttatttgcaggaatgacatcattgattaatctttatgaagcgccgattgctaccgtacaggaaaaattacatataggaagaaagccggcgtgtctggttattgcagtaatcggtatcgttatgtcgctgttaatccagggaattgtatctggctggatggacgttctttctatttatatttgcccacttggagcaggtattgcaggaattatgtttttctggattgcgggtaaaaaatatgtggaagtacaggtcaataaaggaagagaaaatgcatttacgaaattatattttccgatatgtaaatatatttatgtgccaatctgtattttagttcttgtattgggaattgtacttggcggaatcggatgatatagagatatagattatgagaatataatagagaaataagtgtatgggaaaggtgctgcaagcacaagttatggagagaaagtatgagaaggttcagttatacgattaaagaagaacaaggaattcatgcccgtccggcttcttttcttattcaggaagccagaacttatgaaagccatattactatccgggtaaaaggaaaagaagcagatgcctccaatattattgctgtaatggctttagatgtcgtatgtgggcagagagtagaagtagagatatgtggaacagatgaaggcgtggcatatcggggaatgaagaaattttttgaagaaaacttataaaacattttgattttgttaggaaaaacagaaaaaaatataaggagaggtttatgaatatttttgatgtgatcggtccggtcatggttggaccttctagttcccatacggcaggagcagtaaggattggatttgtggcgagacagcttttaggagaagaggtcagagaagcaaagattttattatatggttcttttcttgcaacaggtaagggacatggtacggataaagctttggttgcgggacttcttggtatgaaaccggatgattaccgaattccatcgagtattgacattgcggaagataagggtatgaagctttcttttggggaagcggtgttaaaagaagcgcatccgaatacggcacagctttatttaaaaggtgtttcaggcaagacgctggagcttatcggacagtcacttggcggcggtcggattaatattgcagagatcgatggaatcgagacgaatttctcaggagagaatccaacattgattgtacacaatcttgaccagccggggcatgtatcggaagtgacctccatgcttgcgcataagtcagtgaatattgcaacaatgcagttgtaccgttctgctaagggaggaaaggccgttatggttgttgaatgtgatcaggaagttccaaaggaagggattcgttggttagaacgggcagaaggagttcttaaggtgacgtatcttggaaaggaagaggaaaagtaaatggcggaatatcacagtattcaaagtttattagatctttgtaaggagcaggaaaaacaagtatgggaagttgtgcagcaggcagatatggaggagagtggcgcaacggaaaaacaggtttttgagaagatgcgttttatgtataaggcgatgcagcaagcagataaagactatgaagcagatttgaagtctcagagtggaatggttggcggtgacggggaaaagatgcgtcagtttaatgccagtggaaagaatctgtgcagtgagtattctggtcttgcaatggaaaaagcattgaagatgggagaatcgaatgcttgtatgaaaagaatcgtagcagcgcctaccgcaggttcttgtggagtgattccagcagttcttttaagttatgaagagagtaaaaatgcagaagaagatgaattggtgaaagcactttttgttgcttccggtatcggaaaagttgttgcggaaaatgcatcaattgctggagcatttggcggatgtcaggcagaaatcggaacggcaagtgcgatggctgccggggcattggcatatctgcaaggtgcagataatgagcagattatgcaggcggcaaccttcgccttaaaaaatatgctgggacttgcatgtgatccggttggtggtttggtagaagttccctgtgttaaaaggaatgtagcaggagttgtgaatgcgatttcaagtgcccagcttgctcttgcaggtattaccagtgtgatcactccagatgacacaatcgatagcatgcgccgtataggaaatgatcttccatcctgcctgaaagaaaccagtaaaggtggtcttgcagtgacagaatcggcaaaaaagattatggaacagtttaaagcttcacaaatataaaaagttcacgacttattcttctggtataaactccggattgtttagaatgtcttctagagtgatgccgtagaaaaagtcgtgtaccatagaatcaaacttcttccacataggcagagtacggcattgacctgctcgtgggcaggcatccgcatctttcatcaggcaggcaaccggagcaagacttccttcggctacttcaagaatctcgccaacgctgtactcggcaggagtacgggtgagctggtagccgccgcctttacctcgaagaccttttagcatcttttgttttacaagagacttcagtatactttccagatatttatctgaaatattttgtctttttgcaatatctttaaggggaatatatcccttatttccatgctccgctaaatctaacataacacgaagcgcataacgtccttttgtagaaatcataaaaatctccttttgtcctcaatatcatgaatatattataacatattttatcaaagagacgaaaaaaagaattcctttctatagcaactgtaaagatatcgctgcgtagaaaatgcctgattggcatttttacttgctcccacattacatttgctatagaaaggaattctttttttctgtgttataacatccggcagagcgcatctcgtagcaagaataccggagcattcttgattattttacaagagcaaacagtaaattacctatgccacaaaggcacatgatcagtataggatttagcttccattttctaagagcagcgaaggcagcaataaaaagtaaaagttcaacgatatttactgaggaaatgtgtaaagtctgcccagaaaggacagccgtctgaaacatggaaaatccggcggcagtaatgagtgcaacaacggcaggccgcagactggaaagaatattactgattgctgaagtttctttgtatttacaatatacaagtgccagaatagataccagaatacaggaaggaaaaatcgagccgaaagtagcggcaatcgcaccgggaattccagcaatctgcagaccggtaaatgtggcagaattgacaccgattggaccaggcgtcatttctgcgattgtgataagattcgtgaattcgttcatggtaagccatccatgagtttctacaacctggctttgaatcagtggaatggcagcgtacccaccgccgacactaaaaagtccaatctgtacgaaactcagaaataattgtatataaatcataatttcgtctcctgtaagcatttttatttctgtgtttgtttaagaaaaaatggtttgtactgataccatataaactgaataatgccgatacatgcggctacaagaataatataaacaacatttactcctaagaaaaaatcacatacaaaagcagcggtcatgataaaaatagacagactgcttttttcttttaatacactttctccaagactgcatgcagcatctaaaataacagcggcaacaccagcctgcattccttttaatacgatagctacccatacatttgttgaaaaaatggcatagaaaaaagaaacgatagacaaaataatcataggtggaagaattgttccgagtgttgccacaagcattccggcaagaccatatacattccacccaactaaaatagcggcatttacagcaattgctcccggacaggactgtgccaaagctgtaaaatcaagcatttcctgctcattgatccaatgaagttcatctacaaacttatgcttcataaaagtgacgatgacaaagccaccgccaaatgtaaaagcactgatataaagtgtcgtaagaaataacacccataatttatgcggtttatttttcataaaatccctcttactttctagagagtgtttgaaaaattattcctgtaatctgcacaccctactttgcggtatattttacagaaagtattttttaaacatactctaaagatatttaaaaattaagtttttctacattattaatatatcacttgcgatactattttaaaaatactataattataataaagttcatagataaaaaactataagatagaaatcggatttgagtaaggagaaataaagtgtctattcgccattttagaattttcatcgcagtagcagaagaagaaaacattacaaaagcagcaaaaaaattatatctgacacagccaacggtaagtattgccataaaagaaatagaagaacattatggagcaagattttttgagagaattaatcagaggcttcatatcacagaagaaggaaaaagatttcttgattatgcaaaacatttcattgcgatgtatgatgagatggaaattgcatttaaaaatacagactttacagggaggcttcgcataggagccagtgtaaatataggaacatactatatgccaagactcattcgggaatttcaggacagatatccggggatcaaagtacaggtaaagataaatacaaccgctgttgtagaaaaagaattgctggatggaaagttagatttagcgttagtaggtggaacaatacagtcagaacatatcgttgcagagccattattttatgaaaaatataccgcaatatgtgcgcttgagcatccgatggcaggaaaaacagtgctattagaagaatttatgaaagaaccacttttattcagagagaaaagtagtggcgcatatgaagtattccagagcgcagtaaaccagactggtctcactgttaccccagtatgggaaagcatatcccagacaacgcttatggaagcagtacattacggattaggcgtaacgattctgcctgaacagatgataaaaagagaaataagagaggggcgattagctcagattacattctccgatttctcctttcagaatacgattcatatagcctatcatcatagcaaatatctatctccatcaataaagaactttatccttctggtaaaaactctggacttttaattcattagggaggaaacagacgaaaaaaagaattcctttctatagcaactgtaaagatatcgctgcgtagaaaatgcctgattggcatttttacatgctcccacattacatttgctatagaaaggaattctttttttctgtgttttggctccagaaggaatgaatgtaatagtttttgaggaaacaaggatagaagacagatgaccatggcttatgctgatattatttccatatatattgaacttttttcaaagttcgctgatgataagatgataccgtaagctgttactgcacatgatacatttatcattatattgttgcaatatatcatttttctcttctggacgctataccttccgagcaagcagcagtcttctgatttctcccccttatccctccacaaagacgattgaattcattccatgtgaaaccaaaacacagaaaataaaaataatagaccattgcaaatgtaatgtgagagcaagtaaaaatgccgaacaggcattttctacgcagtgatatctttacatttgcaatggtctattatttttattttcgtctatttcctctctttggggagcgtcagcatagtcttgaaggccttaaatcaccatttttcaaaaaaatttacctctcaaaaaccgcatattttcaccgtatttgcaggtttttaaaaattgttctaaaataaatccctataaacctatttacaaagtaggttaatagtgatatcatcatagccatgagatacatgaaagaaataaatcaataaaaatgagattttagaataaggaggaacaaagcaatggctaacatttataaaggtacattaggactgatcggaaacacacctcttgttgaggttacgaacattgaaaaagaattaggactgaaagcaagagtcttagtgaagcttgaatattttaatccggcaggaagtgttaaggatagaattgcaaaagcgatgattgaggatgctgagaagaacggaattttaaaagaaggttccgtaatcattgagccgacatctggtaacacaggaatcggtcttgcatctatcgcagcagcaaaaggatatagaatcattcttacaatgccggaaacaatgagtgttgagcgaagaaatattttaaaagcttacggtgctgagattgttcttacaagcggagcgaaaggaatgaaaggtgctatcgcaaaggcgaatgaacttgccgaagagattccagacagctttattccaggacagtttgtaaatcctgccaatcctgcaattcataaagcaacaactggtcctgagatttggaacgatacggacggagaggttgatatctttatcgcaggtgttggtacaggcggaactttaacgggtacaggacagtacttaaaagagcagaaaccagaagttaagattgttgcattagagccggacagctcaccagttttatcagaaggtaaggcaggtccacataagattcagggtatcggagcagggtttgtaccggatgtattagacacaaaggtttacgatgaaatctttagagcagagaatgatgatgcatttgaaacagcaaaacttttagcaaagaaagaaggaattttagttggtatttcttcaggagcatctttacatgcagcgattgaatatgcgaagaagccggag

SEQ ID NO: 478 - DNA, 10278 bp, Eubacterium hallii
ccggtgaaataaatggcactgcatcccgcattggacgatcggaaatgccgctttctcttggtaatattgcaccgtttgccacaaaacctgtcaatcctctttcttttagctgccagcgtaattccttttgatcgtctgcaaggaaaacagttttttccaaaaagctcttactctttgtatcccatttacgataaaacaaacagctttctgccagttccggcaaaatatcaaaaacaagtttttgcatctcttttgccataattgttcttcctctcgccggaaatcccatttcaaaacgaagttccattctatccttagaaaaaacaaccgcgattctttcctgcaccgtctgatttgccggacaggtcgtaattcttccgctcttaccagaacccatagatcctttatctaattgacgaagctgtcttaaaaaccggcgcagcacctgatcttctaatgccagtctgcgatgtttttcttcataatactcttccggaaatccatgcgtttccttcttcacttcaaaacgaagtctggaaggagaagcaaagggatctccctgtacatgatctatatgcaaaatataatttccgtaactgtaactacctccaagcgttttatacattccgtaacttttatgatcgattttgatcagttccttttttaaatcttctttattcttcatattcatttccctgcttttcgtattttcactctacagacttcgttctcaaaatcatatcccgaatacctgctccactacatcgctgctacttcatcattacttttcactaagtttaaagaaataaaaatactgggattctaatgccccggataaaagtctgtctactttaatccaatcaccaaaagcggaagttgcacgttttggcagataattggaatccagtaaaagatatttctttgtttttttattataatcagaaatacaaacataatgtccctgtacatgaacgattgctgtatctcctgccttaagctttttctttaaaacgtcgatgcttccacttccaccatcccaggcaaatccatatttttttccgtatttctttgctgctgccttaaaaataccatcatctgttccgcttccgacaatacggtaatttttcttcactgcataattggcaagctccattacatccatatactgaccgttcaatgcgtaaacagcatttactgttgcaagaattccacagcctgcagttcccatacatccacctccgccatatggtgtcgcacaccactccggatcatattgggtaatgacaaatggcttctttgtattactcatcttttgtgtcgcatgaatccgccagtgactccctatatcacttcttcctgtgaaaagtgtcaagctcacagaatctgcagaatctttttcttccgcaaggaaacgcttactcgacacattctgaatcgtataggctccatttaatcgctgcaattcaaactgccctcgtacttcttctggtttttctgtccaacaaagtttataacttcccattttccccttcgctgcattttcccttgaaacactctgaaataccacagataaatactttccatcttctgtattttgaatatagtatttattctgtgtaatatgcattatcttaaatgtgtacttctgatagccttccatttctgtctgatcttttgctccaccgtttttatcatcctgatatccacatccaaattcatagatgccatctgctactgtctgtttttctcttccgtcataaagcaatgtattagaaaatgccccagcggtcatccatccgatctcataatgatcttttttatcgcaaatcacctgatggtccccatcttttttactgatgacgataatcccactatactttttaatcgttgtctgtacctttgaaaaacttcgattcgtataaatgtacatcccgtctcgtactgttgcatacacatttttataatcaggatcgactacaaaagtatcaagggaaaaccagccgaaaccagatttctttccacttgtatactttccgtaaatactttttccactgactctgtatgcctctatgtttagcttgctgccgttcacttcctttaacaactttttcagtgatacatctttataaacagatactttttcgctctttatagaagctgccattactggcttttgctccatatcataaggaaaagctgcctccgctttttttcctgctgcaaataacattgctacacaaaataaagaagttaaaatcactctttttatactcataaattaaatcctcatttttatttactcacttccgtactggctgtatcctataacttcaggtttgccagcgcatctgcaagtgcattattcagtggctgtttttcttctttcttcatttttttcatataatttgccacatcttttttagaaacaccggctccttctttctttcgacggttttcaaatgcctgcatcgattctttatgcccacaagaacatacaaacttctgattctcttttgctccgatcagttccatctttttatgacaaaccggacaacgagcatttgtcattcgggaaatccgttccttgtatccacactctctatcctgacagacatagagcttaccctgtttaccatttactaaaagaagacgctttccacactccggacaaactttattcgtcagattatcatgacggaaagttcctgttccattctgaatctgtttcatcagttcttttgtgtatgtttcaatttctttcatgaactttctatcacttgccttaccttttgcaatcgccgataacctcgattcccactcagcggtaagttctggcttctttaaatcttccggcacaagagacaacagctgttttgccttacctgtaataaatatttcattctccttcttttcaataagatagctgccaaacagcttatcaataatatctgcccttgttgcaaccgttccaagtccacctgtttcctgtaacgtttttgctgcttttgcatccttttgctgcatatattttaccggattctccatcgctttcaataacgttccttctgtaaatctcgccggcggttttgtctttccttcggtttttttcaaagtaaattccccgattacttcgccttcttttaaagatggaaatacctttccattctcatcgccttccggcatagttacttctttgtatcctctgtttaacggaacatttccttcggcaaaaaatgtttccccttcacattgtatggtaatcttcgtctgttcatactcataaggaggatataaaactgcaaggaatctccgaacaacaagatcgaaaatctttcgctcatctactgaaagctgtgccaggataaccggctgttctgttggaatgatcgcatgatgatcggatactttttgattattaacaaaagatttcttcggagtaatctttccctttagcactgtattagtaaagcttctatacggaccaactgcaatcgcctccacacgttcccgcaaggtctctgccacatccgttgtcagatatctcgaatctgttcttggataagtcagcaccttatgatgttcataaagactctgcataatattcaacgtctgtttggcagaaaaaccaaagcgctgattcgcatctcttgaaagatcggtcaggtcataaagcccctccggctgtgaagtctttttcgtcttttttacttcagtaacctctgctgtcttccctaaaatctttttgtaaacttcttcatttttttctctggaaaatgttgccgcacttccagactttttatctttccaggtaaatgtaattcccttaccaataagctgtaaaccataatacggcttcggtgtaaaatgtctgatttcttcctcccttgctgcaatcattgccaaagtcggtgtctgcacccttccacaggaaagctgtgcattatacttacaagtcaacgctcgtgtcgcattcattcccaccagccagtcggactccgctctcgccgttgcagcatgataaagattctcatactctttcgcattcttaagatgtgcaaatccttcacgaatcgctttatctgtcacagaagaaatccataatcttttcaacggctttttattccctgccttcgcaagaatccatctcgcaaccagctcaccctctcgtccggcatccgttgcgataataatttccccgacatcctttcgctcgatcaaagacttcactgcctgaaactgccctcttgtctgtggtataactaccagcttaaaacgttccggcatcattggaagatcttccattctccatgtctttaacttcttatcatagccttccgggtctgccagtgtcaccagatgccccagtccccaggtaacaatatattcattaccttcaatatatttcttcccctgctgcttacagccaagcacgcgggcaatatcccgtccaacagacggtttttctgcaattactaactttttcattctataataatctccatttcatacattatgactgtcctaaagttattctctagagcgtgtttgaaaaatgctttctacaagaggaataatttttcaaacacgctctagtataacagaacaggaaatgggttgcaaataggcgaaacgaaaaaaggatagggattatcactgcaatccctgtccttttttcgtttctgtatttttttaaattgtcaatcctcttcttcttagtattcttttttccaggttatgaaagatcacctgatcgatcacgattccaactaccacaataactaccatgacgagcataacctgattgatatctgcaagatttctccctgtcattaatgtctggccaagtccgatggatgtcgtcattacttctccactcattaatgcgcgccatgcaaatgaccagccttgtttcatacctgatattaattccggaaggcttgcgggaaatataactttccaataaatttgtttttgatctgcccccattgtaagcgctgcttttttatagattggagggacatttaatatcgcattgtctactgcgattgccatactgaatgcggaccccataattactacaaagatgattgctgtctgtgttaatccaaaccacaagatagaaaatggtacccagcaaatacttggcagtgtttgtattcccatgatcagaggtcttaaatttttatgtaaaaatgaaaaatgattcataaataccccaataaaccctccaatcataagggaaagaatatatcctattgccccacgcagtaaactgttcccaattgctgatagcaaggttccctgttttatcatttccgtaaatgaattccacacaccacttggtgagggcatcgcataggctttccatattccaaatccgtcaacaccgatcatatataaaatctgccataaaagaataacaccaagaaggaacagtatttctcctgttatattggatttccatatttttttcatcagtaatcccctccctgtatctcttctaatattttatgtcgataggcaatgaagtcctcgttatagacatgccttggtctatctaactctatcggtacaatatttttgattccgccgtcttctcctgacattactacaactctgtctccaagataaaccgcttcttctacactgtgtgtaataaaaaatattgttttatgtgttttcatccatatatcctgtagttcctgccttaaatggtttgatgtttgtttatcaagcgcggaaaagggttcatccatcagtaaaatttctgaatccattgtaaatgctcttgctagtgctactctctggcgcatacctccggagagctgatgtatcgcataatttttatagtcttcaagctgcatcattttcaaatacttttccgcgcggtaatcctgctccttctttggaactccgtttatctccattccaaactttatattttgaattacattcagccatggaaacagagcgtgttcctgaaacatcactgtccgttccgaaccgggtgctttcacttcttttccatttaaaagaatttttccttctgtcggtttttccagtcctgcaatcagattcagcagcgtacttttgccgcatccgcttttcccaactacacagaggaactctcccggttttatttcaagatttatattttttaaagtagcctgccctgtattctcaaaggtttttcctacattttttaataataatgccatgctctgtctcctttaaaatgccattcttcaaaacattgtcctatccatcattttgcagatgtgtttgtctcctcaacggagataaaatcatcggtcggtttctgatcaataaatttctgatcaagtgaaattgctgcaaaatcatcaactgcatctttatttacatctgttgaaatcgtaagtttctgaaatgctgtctttaaaatgtccgcacttagtgatttccctgttgctgcattaatctcattgttgataatctccgctgctttgtctacattttgattaatttcatctgtcgcttcctcatgttgttttaaaaattcttttactaagtccggatgctcctttaaaaattcatttctcacaacaactaccgctaccggataattgccttccatataaacctgattataatcgagaacgatttctgctccgttctttacaagtgtagaaccccatggttccggaacaagtgctgcatctatatttccctgatccatcatgttctgaacatctgcattttctacagccgttaccgtaactgtgccaccttcttctactgtttttaaaccattatctgaaagcagctttaaaaggcacaaatgctgtgtatttccaatctgcggtatcgctaccgtctttccatctaaatcttttgcagatttaatatccgaaccgggtgcttttaccagttccgctcctgcctgagaagctccagatatcagactcacatctccctttgactttacattggcactaatcgccggaaccggtccaatatatccaatatcgatatttcctgaaaataatgcttccacttcagaaggacctgcattaaaggaagtccatttcactgctgcctttccgtcaaatgctttatcaagtgttccctgtgctttcatataaagagcctgtgcatgtgttacattattaaaataacccacattaatttctgttgtttttcctgcgctcttctttgttccgcatcctgtaagccccgctatcattgctactactcctgccatcataaaaatcttctttatattccgtctcataccttttcgtcctttctttgatttttctgcctgacatcagttcttcttgctctcacatgtgttgtatttatattattcgaaaaacgccttaacaacaatgccattttttgataacgttatctttttgaataaattgactttttacaacatattttttataataaactgatatacagatgatttttttattctatttttataatatttttgataacgttatcaggaggtttttatgtctttaaaagaaatagcccacattgccggcacttcagtatctactgtttcaagagtcttaaatcaaccggattataaatgcaaaaatcctgagctggaatcccgtatctgggctgccgcacaggaaatccgttatacaccaaacactgctgctcaaactttgaaatccggaattagtctggcgcggacagaagaaaaaacaatgacttttgatatttttcttactcgttttccctcactctctcaagatttatttttcagcgaactttttgagtttctaaaaaaagaacttttacgccagcaatgtgtcattggaaagttcctcactcttccggaagttacttctatgttaaatgaaaagtcttctttttctgctaccgacaaacatgcggatggaatcattcttctcggaaaatgtccttccgaacttatttctcctctacaaaatcattatcataatatcgttggaattgaccgtaacccaacggattttgcctacgatgaagtaatctgtaacggaaccaatgcagctatcaccgctatgaattatctcatttctcttgggcataaaaaaatcgcctacataggagattgctcctatgaggcgagatatatcggttattatcaatctttaatttcacacagccttcctcttgactactcaaatatctatccaacaagccagacccgcgaggaagggatgaaaacaatggagctcattctacaacgagattcccttcctactgccatcttctgtgcaaatgacagcacagcacttggcgtatttgactgtctgcggcatcgtagaaaaaaaggatatgttccttctatcatctctattgataatatccgagagtcagagcagacaaaaccaatgctgactaccattgatattccaaaagaagaaatggcacaccatgctgtgaagctacttcttgacagaatccataatggacataatagtgctgcaagaattgagcttccatgtaagctgcttgtcagagaaagctgttctatttctccgcattaacagggttatttcgtatttaccaacacatatcccccagaagctgcagtacttgagaaatagtaagttctggctgaagatttgcatggaatcagatactttacaatttctttcactgtagtatatttgattctctgtttcttcttcgaccaggttctctgcgcagaatctgctacgataactcttccatcatcggtgagtcccagcagaaccattgtatgctttccaagagcccatcttctggttgttctggcactgaaacgtccatttatctgtgttcggttattcgcttcgattactaccgcatttcctgtcttaagatgctttaatatctgtttttctgcctttttattagtaaaagtacgtacatactttgttttgataccggcataattcagtacttttgaaattccatacatggaaattggcatctgtcttaataccggtttactgtaattgcgcttccaggcagctgttccaagtgctttcttttctacaatatttttcacctgaacaggtgtataattcctgtattttttagaataagcagaaagtactgctgtcaaagaagaaacagcgcatccatgcatatcaaggtatttcgtctttttccatggatttttatgctgtccgaaaatagtatactttcttgtaccattctctgaattaacagtgactgtaatctgtcctacatctgacttttccgggagctgtgagactggtgtcgttactgccttcgcctgtatatttaccggaagtgctgctgtcagaatgaacattgtaagcataaatgtgattgcttttttcattcttgttttcattcttgttttcatttttattttcatttttgtcctcattttctggctgatgtactttattgattctgcggattaattaaaatgtaaccgccgctgcttgccttaccaccccagtatattgatgtggatgtcgtattggtacatgggaacatatagccaattaattctccaagtgatgcatactttattctctggttatttccaaaagttttagtagaacggtctacggagtctgctacaattactttctttgtatctgtcattccaagcattgtcatgcagtgatatccgcttgtccatttgttcgctactgcaccagcttttcggctcttagcagcaacaacaaagattaccggattaccagtccgtaaatgtgcttcgatttcctgctttgccagactgtctgaaaaatctctgacatatttatatcttactccatagccttcaagaatcttcgtcattccatataaactgattggcatcggacggctcttactgtcattcgtgtctttcttactataattctttatccactcatcaccaaaatactgtctctcaacagtttctatcatataggtcggcttataggtaacccctgcataagcactaagcactgttgttaatgatgatgcggaacatccatgtccctgcatataatgcggaaactgtgtgcttatattttcctttccattctgtttataaatagaataagttcggttatacggatatcctgtcactgtaacatctatctgatctacttttgtattgtctggaagatctgctctctttgtcacaagattatttggattaataactgtcagatcatactctaaaacagcattacctgttttacacttaatcgttgtctttcctgctttcaaagcctgtacggttccgttattatcaacagaggcaacctgaccgga

SEQ ID NO: 479 - DNA, 10064 bp, Eubacterium hallii
acttttttattttttaactgcaatccacggcagtagcacttatcaatgataagtttcaattgtgctgacattccccaccaataaactggtgtagcaaaaagaatcatatctgcggcagcaattttatcaattgtaggatttgtatcatccttatcgacgcatcccttagagcattgacagacaccacatcccttgcatggtgcaatgttgagtttgtcaggttcaatgatttcaatttcattcttttctaatgctccttttataaatgcattgattgctgtcagcgtgtttccttttctggcacttccattaatgattacaattttcatgcgtgtatcctccaacttcctattttcttaattcaacaaacttaattttattaacttaaccacagtttaacaacttcgctatttcattaactattgaatcaatatcttccttataataaaaattatcaaggagatttttaagctttccttctttattattttcatagaaattttctcttgattttttaaatggtgttttatccctccaaaaagttgcatgcaacttccatgctagcatgacctccaaaaatctcgattcctattttcgtttccatagcatggtgtactctttttcaccagtagcttcatccaaaccttcacattgaataatgaatccttctctttggtaaaaagaaattgctctggcattcttctggtatacatttaatcgtaagctaacttttttatccttaatataatccaataaaagtttacctatgccacatgactgcatctcatcagagacaaaaataccttcgatatattcatcatttagtcctataaatccttgtatcattttatccacttcaaacacatagacttcggattgtgacatcatttctttcactaattcataattacttttccagtattgattggaaataaaataatgtgctttcagatttgtctttaaccatatgtcagcgattctatcgatatctccgttcagcaactttctaatcataacaaatattctccacaactgcgtcctttatgcttttctctttttttaattctatcacaaactcatctttaatcatcatttttttgatattttttccactgtaaaaacagcctctgagcgtttcgttatatagaggggtacacatacagagcaagatccacccatgtttaacagtaatgccgtttagcatttcctttactcatttttaacttttctgattagcggcttatcttacgaagaaagccaagcacctacaatcattaacacaagtgcgacaaagtaagtaacatcaggtatttctctaaagataatcaacgaaagaattgtcgctataaatggagcaacggcataatatgcacttgttcgtgctgcaccaagtaatctttgtgcatatacataaaagtaaatactcaatccgtatgccacaaatcctacacaaagaacagcaacgatactccaaagtgcctctatccgttctccaataaacaagccgataatgagggaaccgatacccgaaaatattccttttagcagaacaatctgcaatggatcttttgacgatatttttcgagtgcaattattctcaaatccccaacaaatggtggcaagtaaaacaaataacgaaccatatgagaaacgcagacttgatacatcttcaaaagacagtattccacaggataatgttacaaaaaatatcccaaaccacaatcttgtgctgattttttctttgaataccataagggcaattatcgctgttgctacaatttcaaagttattaagtaacgacgcatttgcggcagttgtagagtttagaccaaacagtaaacaaataggagcagcaatatctaaaactatcattgcaatggtgtatggtaattctgattttgttaatttcaattcttttgcttcatatttctttattttccgcataagagcaataaatatcattcctattcctgcaccaacataaagaaaaccagccattaaagtaggcggcataaattcaagcaatatctttgaaaaaggagcatttatagcatacagtgctgctgcaagtatcgcaaatgctatccctttcttgattttctgttcagtttccattttcttgacacctccaaagtactacgatataatttgtatgttatctaacatcttgttcgattatatcattagcatatttgggcgaacaataattaaatcaaaagaaatgtacgttattgaacatttcttcaaatttgtacggaggaagataatggatagaagacagcaaaagacacgagaagcaatttttcatgcattcagcacattgcttgaaaagaaaagctacaatcatatcacagtacaagaaatacttgataccgcaaacatcggcagaagtaccttttatgcccattttgaaacgaaagacgaattattaaatgcagtctgtaaggaactgttcggacatatcatcgacagtgctatggataaaactcatatacacgggctttactcaaatgaagaaatgccacaatctgttttttgccatcttttacagcatttgcaagaaaatgataacaatattttaggattactatcttgtgaaagtagcgaaattttccttcgttactttaaggatagcttaaatgaattggtacaaacacaatttataaatcacaaccgcaagcgaaatcaagacttaccccaagaatttcttgttaatcatatttcaggaagctttgtagaaatggttttatggtggttgaaagataaaaaaaaacatacaccagaagaattagattactattttcgtgctgttattgagccgattttataaaaaattaagtgggcaacaaatctcattttgatatcgttgcccactatttataattactccttttttacaaatgtgtgtctaatgcataagcccttataattattcgtttttgccacttttatacattttctattcattttttgctaatggggagcttatttttcgctaagttgtcgtgcgatttattagaatggaatttttgaaacagccagcaccttgaatgggctggctctttcaatgtcacctgtaattgacaaactggaagttgactatcaactgataatcaaaaatatcattcctaaaattgcaaatccttcacagatcgcaattatctaaaatctgtcgagctcttcgtatagaaaaacagtaatttcattctttcgaaatttttaattctacgtctccgttactcagcaattctacaacctcacgctctggcatattcatttttcccagtcttacctcttgtttatcatcgttcacggaatccttgttagaactaccacatgcaaccagacaggctgtgaggataatttccagaataactgataaatatttcttcatatggctacacctcgttctttattatttcttttcatcaagcaaaataacaccttgcgccggatttttatcaattgcaccaactatctcatgtggaacatatggctcttcaagatatgcaaggtcttcggcagttaatttaatgtcaaatgctccggctgaatcatccagatactgcgttttggttgccccaataataggcgatagaattccctttgcccactgccatgcaatggctatctgggacattttgcagttatacttttcggcaagctccgctacacgtttaactatctgcatgtcttccgcttcagtcttatcatattttcccatggcaaccctatccgtggttccacgaagagactctgatttccactgtggtcttgccagatgtccggctgcaagagggctatacggcattaacgaaactttcatttgcttacaaattggtagcaattctctctcatcctctctgtaaagcaaattataatgattctccatcgcagaaaatggtgtccatccattgtctcttgcagctaactgcatattataaaactgatatccatacatggcagatgcaccaagtgccctgacctttcctgcttttaccagatcgtgcagtgcctccatagtttcttcaattggtgtatcatagtcaaatctatggatgatatataaatcaagatagtcggttccaagacgtgacagagttccatctatttccctcatgattgcctgtcttgataaacgaccttcattaaaatataccttggatgcaatcacaacctgatttctcgctacatttttcttcaatgctttacctaaatattcctcacttgttcctgctgaatatccatttgctgtatcaaaaaagttatatcccaaatcaagtgcatgcttgataacattctcactttcagcttcatccaacgtccagtcatgcatggttccagctttcccaaaactcatgcagcccacacataattttgacacttctatatctgtatttccgagtttaccgtattccatagtgctctccttatcttaatccagcgtactctttctccgataccgcctcacaccactcattggaacaatccactcccggcacctcaattgccagatgggaaaaccattcatccggagcagcgccatgccagtgtttcacttctgccggaatattgatgcagtcgcctggcttcatttctacagcatctttcccttcttcctgataatatcctcttccggcaacacataccaggatctgtccgcctccactttttgcatgatggatatgccagttatttctgcatcctggttcaaatgtcacattgaaaattccaacctgagatgtagagattggtgcaagaaaacttctgccagaaaaatactgtgcaaatccatcatttggtgcaccaattggaaataccatctcttttgcatgcgcccgcatcgcttcctcttcgtatggcaaatctccttcgcctgtctcccacacttcctttgcaagattgaaaacagcccatgcttttggccatcctgcataaaatgcgacatgtgtgattactgcggcaatctctttttgtgttacaccatgattttttgcattttgaagatgatattttaaagaagaatctgtaattccggaagccatcagagcaaccactgtgatgatacttcttgtttttacgtcaatatcctggttattccagttttcaccgaaaaggacatcatcgttaaaatgtgcaaactccggtgcaaattcaccaagtgcatttcttcctgctgtctgtattatttttcccattttctgtatacctccatagcactgttatttataaagattttacccactcactgatttccttttttgttccacggtttaacaggctgccttctgtgataactgcatccggtgcagatggctgtaattcctttacagtattaccgaatccacttccaccggatgttgcaaaaagcacgatctttttaccgccaaaatcataggcttccaaaaatgtattgacaattgtcggagctacataccaccagattgggaatcccagaaggatctcgtcataagaactcatatccatctttttcttcataatctccggtctgtatttcttatcactcatttccacactgcttctggattttttattcatccagtcaagatcagcctttgtatatggaacttttggctcaatctcaaataaatccgcttttacttcctctgcgatcatctgtgctactttttttgttgttccgcttgcactgaaaaatgccactaattttttactcataataaaaagcccctttctatacgtatttttcacaaaaaaatagatgtataagatttacattcatcttacacatctattttaagctctatcgcttcattatgtctaatgcttatattgaattttattttatgcctgaaaagcattaatctcctcaatcattttactgaccgccagagaatatggaatgtttcgtctccaggcaatcacagtacttgttgtgatttcaggagaaattcttcgctgtacaagaatatcctcccgccaatactttgcagcaccttcgatggataccggatagcccagtccatttgctgccataactccggcattcgttccaagattacttgtaaaagcaatctgcagtttcgaaaagtcttttccaaaccaattggcaagttcactttgaacatttactctttccggcaggatcaatggttttccaataagatcttcttttcttataaactctttttctgccagcggatcatccggccgcattccaacacaccagtgatcgcaatctgtgatccggatataatccagcccttcggtgtccaccggctccatgaataatgcaatatctacaagtcctttgttcatcatctcatacactgcatctgctgttgcagtatgcaatacaatctgaaccagcgggtatttttctttatatgttttacatatctccgccaatgtctccaccgctgcaaattcaccgcatccaatggttatatttccctctacaacatcttcttttcctttcagttcctcaagtgttttttcctcaagattaaggatctccagggcacgcctttttaataaaatcccctcttcagtaagcgaaattttcttcccgcttcgaataaataatgttactccaagctcctcttcaaatgccgccatttgtctggatagcgttggctgagtaatatgcaattgttctgctgcttttgtaaagctctgttcttttgccaccgtcagaaaatagcgcaatagtcttaattccatattttttattcccacagcttccgattttactttgtaactatgacttttccttctgaatccagaagcggtgtaatagccgctccaaatccagaattccaacaaagatagttaaccccagtctccttatctacaaggatttggcgaactccttcatccttaagctgacttccgtctctaaatgtaacttcaaatctttcttctttctttgccatgtttatttctccttttttcaagcgttaaatttaaattttcctgttatacaaacttgaacttgtctatttcttctttttcggttttggggctggcagttcatcatacattgcatgaaacaagcctgtcaaaaattccttattatcaacttcatctaccaacaacatctcttttgctccctcatagggtaattcatacggagctgtcggcatataactaattgctgattttactggtttaacaagtaatctatcatcatagataccgcctacaatcttgccacgataataaataataaattctcccatcatagctcgataagtaatttcttctaactcagatagctgccctaaaataaactctaagtattccttgcttgatgccatatttccacctcaaattcatatttctcagtttcaaaaacttgaaattacttaacaatatgtgctgtaatgattgtatagctatatgaattgatagtaattttgatattttcaacctcgcaataccaatttttaccctgtttgtatatattgcaatttttatctaataccttatttttgcaatactcaacaacatctgctgtatctatttttaggtttcttttaattctatcaattcccatttcggttgtatgaattttatcaatattatcaagcaatatctttttatcttccattctttcttttcctcaacttccgatttagtaacgcaaaaagaaatatatgacatacacccaactaagtaatccatgaaaaattgcccaaccgacagacttccacgttgtataactaataaccatagctaacgcacttccaaaagttattcctgattttaccgttttcttgacagtagttgatttattatcttccacatttgtttcctccgtaaattttgattttcttaattctacaaacttgaatttattttaatatccatggtcaacatgttgccattgtccgccgtttgttctaactaaaatccacttccaatcattgtatgtactatttggattcagagaaccatcccctccagatgaatcaacatcgaatgaagatagcaaaacaatgacttcatctgcattgttcctatttgcccaatcttgatggtctttagagctgtcatcccctgcataataaatttctgtaagagtacatccattccagttgctcttaaactctttttttatggtgtcaatagcagctgcaatgtcctcttcagaatatatttcagattctacattatgcgtatttacttcattaacatttccgccacaagcactcaaactaaatacaagcagaatacatagcattgcacatacaatctttttcataattcacactacctccatcaattccagtttgcacatcaaatcgttttcttcattctatcacagtatcatattattccgccatcaatttttcgaaccaggtatccatgacaataataaactggcctgcgccttgccattcttgcagcatttcatccagagttttgtgtttctcatatttctgcacatacacccaggtggctataccactggcctcagaaataattcctgttatgatcttacgcatgatgccctcaaattctgcgatttcctcttttgaaacgatgtcatagagattaggaatctgaaaatcttctttcccacagttctcatgtacattaatcaactctgctttcaccctttttctggattcctcgggtaatttcaaatattgccagatcattgagaccacttcggaaggtgtgtcttttttgatcggtggtaactgaataaaatcattgttttcgctcattttcatatcctcctcacgataaaataaaatcaataatactttctcttgtcatatccagtacagtgtctataaacactcctgcaaacaggatcagatacagaattacactcagcgaaaacaggaatgcaacctgtacccaatcatggtaacagtatgcagtcgctataatcaacaaagtgaatataaatccaaggattcctctgacaaccgcataagtctgtactgtcatcttcactgccaggccgatcacaaaaagtatcagccataccggcagtaataatatcttcccagcaagttttaaaataaacatgtgcacctcctatcttaccagtcctggcatatcatggttcacttctgcctgataatacccattcatcgtagacggtgcattaaacagggctgctaataaatatttcttgatgttcttcacctttgtggtgttaccacgcatacagtgtaagacatactcgatatgtgaataggtcagcatcagaaattttttcttcaccagagatgccggataccagttgctggcaatcaagatcttgtcatttttacacatcacagtttctacgatcaggttcacgacttcatctacctgtcgcatatcgtcatgatgggttatttccagtgattcataatcaatggtctccttgacaaggttttcataagcctgataatcctcagagcgattatcgctatcacatcttttctcatccacagatatgatatgattagatttattatcattcatttcagtatcactaagattagtattattagggtttgaaatgtaaacttcttgaagtttgttttcgggacttctagaagtttgattttgggacttcatgaagtttaaattgtaaacttctgcagtctcttcattttccacagaagtttgttttttaaacttctctaattcctctccaaattttttctcatctgttttctcaggcataaaggtttttacgtagataacattcacctttccaaatccctgtctacgtttctcaatcagaccaattcctgtttcgtcatccagttctctcatggatttgatggctttatttctgccacagttcagtaattccatgatatcttcgatggaaaagtagatatatgctctgtttttgtcgtcaaaccactgattcttgatggaaagagacattcgatccaacatcagtccatataaaattttggcatcgcttgataaatctttaaagtagctgtctgtaaataatgcttttggtatgcggtagaagctgaactgatcagcttcggtaccgtaaaaataattaaatgtcatttttttctccataatttcctcctttcgttttctgctaagaagtc

SEQ ID NO: 480 - DNA, 10054 bp, Eubacterium hallii
tgctcgttaagagcgagaaaataatctttggacgatacatcttccgagcaagcagtagtcttctgatttctccccttgtctccaccaaagcctattgcattcattccttctggagccaaaacacagaaaaaagaaatactaccatatcccagatgcggcttcggagcgtatttaagatgcggatgagcatcttaaacacagcgactacagagcagatgggatatggtagtatttcttttttcgtttgttttctctaaatgaattaaatcgttacaatctcatctttagatacctgtccctctcttactcggaaagcatggattacaggattttcctgatccatcagggacataataagataacttgcttcggaatcaaaggcaaggcggatatcctcctgtgacggtcttgctggtgtttctggatgggagtgccagtttccaagtggttctaatccgttctttctcatctctttgattgctgcaagctgctcttttggatctaaagagaaatgttcgtttgtatggtcaatatttgtaaggtaatatactttttttattactcgttctgtgtcggatttttcgccggcgatgagtccgcaggcttcttccggcaggtgggcaatggcatgggctgccattgcctgaaagtcttcttttttaagctttacctgcatgattagattccctcacattctgtctgttcataatcgataagctctgtgattgtcggatgttcaccacatacagcgcaatcttttgtatgtgatggaagtttaatctttctaaattccatctttaatgcatcataagttaagagatatcctgtcagtaagtctccaactccaagaatgtatttgattgcttccattgcctgaagacttcctatcactccacccattgcaccgatcacaccggcctgtttacaggttggtactgcatcctttggcggcggatttttgaatacacaacgataacatggaccttctcccggcacgtaagtcatgagctggcctttgaaacgaatgattccggcatgggaaaatggtttctttgccattacgcaggcatcgttaatcaggaattttgcagggaagttgtctgttccgtcaatgataaaatcatagtctttgattaagtccatgatggattctgagtctacaaaagtacggtatgtaattacttttacatccggattaatagcttccattgtctcttttgcagactgtactttcgccttacctacgtcctgtgttgaatgaatgatctgtctttgtaagttagataaatctacttcgtctgcatctgcgattccgattgttccaacaccagctgctgctaaatacattgcggctggtgcaccaagtccaccggctccgataattaatactttggcatttaataatttcttctgtccttttgcgccaacttccttcaggataatatgacgggagtagcgttcaagctgctcgtttgatagcattatcttccacctcccatgaaatacaggaattcaacctcgtccccatcttttaaagctttttcaaaatctgctttttcaatgaattcatcatttacagatacggtaacgtattccggtgtctctacattttccttttcaataagctgtgtgacatttaatccgtcttcatattcttttacttttccggcaactgtgattttcacgattctatcctccattatatctgttttatatttctaaaatcatatctgtcttattatatcgaccttaccttaaacttttatattcaatttattatatatgtctttacaatcactttgtaaatatatgcaaattgctatacatgactttatatctaattttataaatatgttttgttctgccttttatcagtttttgttatatgctttactacttattcttttcaatcgcttcttcgattttatgtttacttacagcccctgtaattcgatctacctcttctccgtttttgaagaaaataagtactggagaggacataacgctgtactcttcgatgagttcctgctcgtaaacaatatttacttttccgatatatacgtccggatatttttcatccagatctgcaagaatcggagataactttttgcatggaatacaactgtcagagtagaagtctgcgattgcaagtcccggtgcatttaacaccttttcctgaaagctgtccttatttaatctttctgccataactgttctcctgcttgggattttcctgttttattcttttaacttcctatatgtaactttattctccaactttctttacgaataaagtatatgttccgtcatcatttgtatttaattttaaaatctgatgtccttcttctttgatacttcttggaacattctgtactggctcgccatcattcatttttacggctaaaacctgtccttcatccatttcttctaatgctacttttgcttttacaaaggtaacaggacatacaacatctgtaatatccacctgttcatcaaaatgtatttcactcattttcataggcctccttaattgctttttcaaacgcctcttttcctgtacggtcaatcgtgaatttaagtcgctctcctgcttttccattctgttcaaagaattttaatgcggcatcacatacttttaataatttttcgtggctttcgataaatggaataattgtctcgcctttgctgatatgatttccaaatgttccaccgaaagaaacaatatatcctggctgtgcatcgtatgcatctaccggacaggactttacacatcgtccacagtagttacattttcctgtgtcgatactgatttttccatcttctaaagtaattgcctcattccgacaggcttttacgcagacaccacactggatacatttatcttctacccatgcaacctgcattccacctttgattcctacatcattttcctctgcttttaagcagttattctggcatcctgtaataccaaatttaaacttatgcggaagttcatatccaaagtatctttcatccaattcttttgccagtgtgtaggtatcaatacatccgctctgacagattgccgctccctgacaggcagtaacggttcttacacgaggtccgcatacgcctggaacaacatcgccttctgctaatgcattttttacttcttcaatctgatctagtttaatgaaaggaatctccacaccctgtctggatgttaaatgcacatatccttccccgtatttttctgccacttcggcaacttttgcaagctgctctgcactcatatgtccgccgactgtacgaagtcttaaagaaaaattatttttctgtttctgacgcataaatccgccctttttcaaggttgcataatctactgccatgttatcctcctgtaattaaatgaaataccctgttttttgtttctaatgattattatatattttttacagcctgtgtaaagtcttcaatcaaatcttcgacatcttcaagtccgacactaatacggatcgtatcatcatacacacctgcatgttcctgttcttcctgtgtgctatgtaaataaatagtcgatgccggatgaatgacgagtgttcttaaatcaccgatattagtggctatcaaggcatactttaaagaattaattaatttaaatgcattttctctggaacctgcccggattgtgaggatggcacctccaagtcctccgaactgttcatcgacaagtgttttatacggactgctctctaatcctgggtagtttactgtaattcccggaagtttttctaatgcctttgcaagtgtcaatgcattgttacaaagtgctttcattcgaataccaagtgtttcaagccctaaaatattaaggtaagcgttcattggcgcgagacacccacccatatttctccacacatcgtttcgaagtcttgctgtgtgggcaaactttccatatttgctatattctttcatcgcaggatatctctctttatcccattgaaactttccaccgtccacgataattccactgattgcatttccgcttccattgatatatttggaactggaatgtatgacaatatcggctccggctgctaatgcatttataagataaggggtcgctgtcgttgcatccacaatgaatggtactccattttcatgaaggaaatcagatacttctttaatatttacgacatcaagtcccggattacctataatctctccaaaaactgctttgatgtttttatttaaaaccggtttgatatcttccactgtaatgtgtggaataaaatgtgtcgtaataccaaacgcttctaaatctttgaatagatcaatcgtaccgccaaacagtccgcttcctgcgataatctcatctccggcacttaatatattaagtaatgccgatgtgattgctgccattccggaagcacaggcaacagcgcctgtacctccttctacctcattgattctctgctcaaatgctgcaactgtcggattaccgattcttgtataggcaaatcccggtgctttatttccaaatactttttcaagatgctctgcagaatcataagaaaaagcacttacctgactgatccccggaagcgttgctccatccggcgtatttcttcctgctttgccatgaagaagctttgtattaaacttcattttcgtttctccttttagatatggctcgcaacaccgtagacatcttccgcatattctgtaagtttacggattgtctgtactgtactgtccacatctcctttttctccttcttcccagtgcttgatatacttgctgtattttgctaaggagcctttaatttcttctttattctttaaatctttgttcagaacaagtaatacgataataccagctctgtttaaatgtcttacgacaagtcctaccggctcatcatcctttggtgcatagaggtatgtatgtcttccacctaatgtcagttctttttctacctgttctacaaagcttcttgtgatattctcatctgaaagatcaaatggaattgttgctgctctttgtcctttaattacagcacgaagctgatctgctttctttcctgcttcctgtccatcttcttttacttccgttacaacaccgcaggcagaagtcatgtttgttactcggtcaatcaggattaattctcctaatgtcttatgtttgctaaactcatcagccacaacacgatcgacaaatgtaatctcacattctgcaatctcattctttcctaaagaatcggctggtttctgttcgcctgtatttacatcgatagagtaaaggatttttgaaacgataccaggtactaatctggttcctaattttacaaaataattttttccactttccagtttatcatcatccatccaaagcaacgttgcttctacagaagaagttactttttctcctgcacctgcggataatacacatcctcttgatacatctacttctctgtcaagctgaatcgttactggctgtcctttttctgcagactgtacctctttgtctgttacgtgaatggacttaacatgtgctttttccatacttggcaatgccgtaatttcatcgcctaccttgatgcttccactttcaatctgtccctggaatccgcggaactgatgatttggacgacatactctctgtaccggaagatagaaaccttcttcctgattctcatcaatatcaacctgctctaaaatagagaggattggttttccttcataccatttcatgttgtcagacgcttttgttacgttatcaccttctgtagcggataccggaacgatatatacattttccagtccaagttctgcttttaatgcttcaatctgtttttcaatttcacggaatctgtcttcactgtatttcgcaagatccatcttgtttacagcaaaaataaaatatttaattcccattaatgcacagattcttgcgtgacgtcttgtctgtacgagcacaccctgcgttgcatcaagaagaataacggctaagtctgcaaaagatgcacctactgccatgtttcttgtatattcttcatgtcctggagtatctgctacgatgaagcttcgattatctgtcgtaaaatatctgtaagctacatcaattgtgataccctgttctctttctgccattaatccatcaagcagtaaagaatagtctatttttccaccacgacttcccacttttgagtcaagttcaagtgctttttcctgatctgtataaagaagcttggaatcatacaggatatgtccgatcaatgttgattttccgtcatccacgcttccgcatgtaataaattttaataatcctttcatcttagaagtacccctctttctttcttctttccatgctggctgctccgccgtcatggtcaataacacgactggttctctcggaatctactgcgctaagtgtctcatcaataatctcgtctaatgtatgcgctgtagattcaataccacctgttaacgggtaacatccaagagtacggaatcttacgctcttatgttcaatcttttcacctggacgaagcttcattctgtcatcatctaccatgataatattgccgtcacgctctactaccggacgttcagccgcataataaagtggcacgatttcaatattttcacgtttgatatactgccagatatctttctctgtccagttagaaatcggaaatactcgaatactttcgccctgcttaatctgtgtattatataacttccacacttccgggcgctggttcttaggatcccatgcctgttctttatttctaaaggagaaaattctctctttggctcttgatttttcttcatcacgacggccgccaccaaatgctgcggtaaatccgtattttgtgagtgcctgttttaatgcctgtgtcttcatgatatctgtgtaggctgaaccatgatcaaatggattaattccctgttttacaccttcttcattcgtgtatacaatcatgtcaattcctttttcttttgcaatcttatctctaaattcaatcatttctttgaatttccatgttgtatcgatatgcataaatgggaacggcggtttttccgggtaaaaggctttcattgccagatgcagcattacggaactatcctttccgattgaataaagcataactggcttctcacattctgctgccacttctctcattatgtatattgcttctgcttccagttcatcaagatgtgataatgttcccatctcatttcctcctttttataaatgttttctatactaatatttattagaatccttcatgttaatctcaatggtctttgtctgtccgtccgggctgtcaaccctccacacacgaacatcacctttttcttttacagaaagcatggatcccatgcctcccatgtcggcaccaagaaaatataaaattgctccggtgtgacattcttttaaacaggcggtacatccccagcagtttctgatattgcggatatgtactttgccatcctcacctttttttaagagatttccgggacagacagaaaggcatcttccgcatcccacacatttattctgtaaaatccgtacactcatatacctttcctcctgtcaccagttctctgaaaattatttcggtcccgccatccggctttctctttgaattcacatatttaagccacttgctgctttcttccggataatcggtattctctccgaaactgtgccatcttgtctcttttcttgcccgtaaatgttctattaaagtctggcacacaatcaacctttctcttacttcgtagatatctttcaattcaaacatatcctttgctttaagttcatcaaccattccaagaagctcaccaattcgctttttgccgattaccagtctttcttcgttgtactgataatctgtagcaattccgccggcatactgatccataaccttctgcatagcttcttcaagctgctctgcggtaatgaaaaatgtatcttcgctgtcattttcttgtgcgattaaatgagattcatactcttttttctttaatgcagcagcagtatctatcattgtttctgttttatgtacagcagcatcttccttaaccgctttgctcttttcttttaaaacttttatatactctgtcatggattctgctgcaatctcgccttctgctaatgctccggttacatatttctgtggacagcctcctgcaacatcgcctgctgcaaataaacctttgactgtggttcttctaccgttatctacccagtagccacttgccgtatgaccacctacaatgtaaggttctgtaccttcaatctcaacattttcacttgccggacctcttgaaccttccagccatttcaaagtctggctcggtgccatgttaaggtaggctctatataaatcctgttcctgtgctacactgatctcatccgtttttaaataacaaggacctcgtccttctctgttctctgttacagttccatataaacgttgagaagttgtaagaccatactttgtctcataaatctcaccatgagcattcatctgctttgctccaacgccctgtgcgatcgttccgaccggtgcgatcgtatctttacatctaagagcaataaaccgcatttcaaaagttgtcatttccgctccggctaaaattcccatcgcaaatccggctccggtattaaatggggaataccacattttatgtcttgaaaatccgggattattcggacggtaaagccctgctgcaccgccagtcgcacaaagaatagcttttgctcggatatcatagaaaacattctcttctatattaaagccccaggctccttttacttcattctcttctattatataatctgtgatattcaccctctcaagcacagtaacattctcctgcgccattgccgcttcggctaagagaggcttaatattctcaccgttaatctttatatttcgattccctcttgcaacgtattttccattctcatctttcagaataaccagtcccagatcatcgagaactttcgttacatgattcagtcgctcggacatagataaaagcaagtcctctctgacaattccatgcgcatcctttttcgcataatccacatagtcctgaggcacatgcccttccgtaatataggcatttaaggcgttaacaccagctgccagacagccgcttctcttaatattcgctttttccgctatgagaacacttacccctgcttcttttcccaaagtgtaggcagcaaagcaacctgctgttcctccaccgatgattaacacatctgtctctaatttctttgtcttcatgtctaccctcttgagtatctaaaattcttatctgattttatctatctaatttatctaatctaactaatctaaaaatctgattctaatctaaatgtaatacatttcctgtccactctgactgtactccaaagaagaatctaccagtgtttttaatgttaactgttttaataacttatccgtctgatcattcatctgctcaatcagaagtttctgtatcgctgtcgatatccccttttcatctgctccacttaccacgcttctttcatcttccagaagatagcttccatctaacgcatagatcacatctgctacagtaatgctttccggactttttgctaaaagataaccgccctgtggtccctttatactttttaccagccctgctcttcttaaaccggaaaaaatctgttccagatactttacagatatcttattgcgttctgcgatactacttaactgtacacattgatttctagcatatactgccagatcaatcaatgcggtaatcccatacctgcttttcttcgaaagattcattgattgtcacctttcttttctatgaattattcagtaaataatgctgtagagtaatatctgtctcctgtatccggaagaagtgctacgattgtcttaccttcattctccggcttcttcgcatattcaatcgctgcatgtaaagatgctcctgaagaaataccaactaaaattccttctttctttgctaaaagttttgctgtttcaaatgcatcatcattctctgctctaaag

SEQ ID NO: 481 - DNA, 9800 bp, Eubacterium hallii
tccgactgagataaacgctccgcgaggatgcgcagtgattctgtaaagaatatgtcagcttacgctgaccagaatcacgcgccaagtctcgcggctgctcgacttgaatatattaagtattaaggtaaatgcaaataaaacgattgtgattttgaaacgaatatactaggttatattgatcagaatcatgcgaagtcttaggtgcattcgatttgatttttatgagtagttacagtatatcaaattttatggaacaggtgaagaaaaaaattactaaaaatatagtaaaatatttagtaaagatttctcttgataaatttactaaaatactttactatatgaataacacgagaataacgactggaaagaacagacggacatgtgtgtattgcaaggtatagtgagtatagtaaccgtaggaatcaggaatgaagaagggtcggattttaagaaaaggagttcaaggtaattatgaaaacaacagaattaaaagcagggtttcagagcggaaaatatgcagaattattgaaagatatttatattgatgaaagtgtcttagaatatcagaaagagcgctatgttaaggcgattgaaagttttgaagaaatgtttggagtaaaagacgtagaaatctacagtgcaccgggaagaagtgagatcgggggaaatcatacagatcaccagtgtggaagagttctcgctgcatctattaatttagatgcgatcgcaattgtagccaaaaaagaaagtggtattgttttaaaatcagaaggatatccaatgatcaatgtttctttagcagatcttctcccaaaaaaagaagaagaaggaacatccgctggtctgattcgtggtgttgctgcaagattaaaagaagaaggatatgaaattggtggatttgaagcatatgtaacaagtgatgttttaaatggagcaggaatgtcttcctctgccgcatttgaggtgctgataggtagtattttatccggtctttataatgagggaaacatttctccagtattaatcgctcaggcaggacagtatgcggaaaatgttttctttggtaaaccatgtggtttgatggatcagatggcatcttccgttggaaatcttatttttattgattttgctgatgtgaagaatcctgtaattaaaaaggtaaatgtaaattttgaagattttaatcatagtttatgtattgtcgatacaaaaggatctcatgcagatttaacagatgagtatgcagcaatcccggaagagatgaaaagagtagcagcatattttggaaaagaaatattaaaacaggttgataagaatgaattctatactaatattcctgaaataagaaaggttgcaggagatagagccgtacttcgtgcaatgcactggtttgaggaaacagatcgtgttattgaccaggtaaatgcattagaagaagagaattttgaggaattcaagaagttaattaaatcttccggagattcttcatttaaatatcttcagaatgtatattctgtgaaaaatctttccagacaggagatggctgttggattagcattaagtgatgtaatcttaaaaggaaagggagtaagtcgtgttcatggtggaggatttgccggaacgatccaggcatttgttccaaatgatattgttgatatttataagaaaaatatggaagatatttttggtgaggatgcctgccatgtattaaaaatcagaaaatacggtggaatgaaagttttatagaattttccaggaggaatgaaaagtgggattaacaaagaatattaaaaagcttgttgcctatggtattggtgcaagattaattcagccggaagacgagatctttatgataaatcagtatctggatttatttggtttagatgaatatgatgatccggatattgatgatgagaagattgttcttgtggatattttaaatgccctgacagatgaggcatttgaaaaaggtatcattcaaagtgatgatatcgtaacaagagatttatttgatacaaagctgatgggaatcatgacaccgcggccaagtgctgtacagaagacatttaatacttattatgaaaaaggtccgaagtatgctacagattatttttatgaactcagtgaaaatagcaactatataagaaaagaccgtattcagaaagacaaaaagtggacagtggatagtccatatggtgttattgatattacgattaatctttcaaaaccagaaaaagatcctaaggcgattgcagcagcaaagaacgcaaaacagagtgcgtatccaaagtgccagctttgcatagagaatgaaggatatgcaggaagaatgaatcacccggcaagacagaatcaccgtattattccaattactattcatggaagcagatggggattccagtattctccgtatgtatactataatgagcactgcatcgttttaaatggtgagcatacgccaatgcaaataaatagagatacatttgctaagttatttgattttattcgccagtttccacattattttgtaggttctaatgcagatctgccaatcgttggaggatctatccttacccacgatcatttccagggaggacattatacttttgcgatggaacgtgcagaaatggagcaggaatttacaattccaggatatgaagatgtaacagcaggtatcgtacactggccattatccgtaatacgaatccgacacaaagattcggaacgtcttatagaacttgcagatcatattcttaagaaatggcgtaattacagcgatccggaagcatttatctttgaacagaccaatggagagccacataatacgattacaccaatcgcaagaagaagaggagaagaatacgagcttgatctcacattaagaaataatatcacaacagaagaaagaccacttggtgtatatcacccaagagcagaatatcatcatattaagaaagaaaatattggtcttattgaggttatggggttggctgtccttccatcacgtcttaaaaaagaaatggaaagtctggcagaatgtcttgtgaataaaaaagatattgcttctgtagaagaattgaagaaacatgcagcttgggtggaaggattcttaccaaagtatacggaaatcacacaagagaatgtatggaatattcttgaaaaagaagttggagaagttttcgtaaaagtattagaagacgcaggtgtatataaatgtactgaagaaggaagaaaagcatttatgcgttttgtgaatacactttaatcttgatgtagtcttgatttatctcagtcgagaagactcccacctctttcaggtggtgagtgactgctcgacttgaatgaaaaaagaaaagaacgagaaataaaaagatatactatagtatctgtgacagtagtttcagaatggagaatgtttcatagcatttttcattggaatggaactcgcagttgctatagtattttttttatgatcttggacagctttaaaaagtaggaaaggattccctaaaaccctgcattgtggtataaagaagttataaaaataaatgaagttataaaaataagtgggagtgtttgaatatccatgatgacagaagagtataaagaggaatataaaaaagcaagaaaagcggcaatgaagcagtatcgtaactgtgcatcaaaaggctggtctttatatccaccagtattagatgaagtatctgcgtatgtaaaaacagcaggtgaggaagtacttggagaaatggaaatacccctttcgcttgtgactggaacaagaactgccggcaggcagaatgcattcagtaaagattttcttccgattcttccggagaacagtgaatttgcaagaaagtggattacactgtatgaggcgcagatggaagaagggattcgtgacccgattttagtttatgaattcatgcatcagttttatgtgcaggaaggaaataaaagggtcagcgttatgaagtatctcgatgcctcgcgtattatggcaaaagtcattcgtgtcataccagaaaaaacagatgacccgtctgtaaagctttattatgaatttatggaattttatcgtagtacaaaaatatatgatattatctgtaaacagccgggaaattatgcaaaactactggaacttatgggaaaagaacggaacgaagcttgcagtgatgaggaacggaagaagttaggaagtcttttttatcatttttcttccatatatcatgcgaatgcagctgcaagaaatgaaggagaggtgctgtcagcaggagatgcctttttgatttatctaggtattttttcttatgaagaagcaatcagtaagccagcctcaaagcttcgggaagaaattcttaaaatgtggaaagagtttgttccagtaaaagaggcagcgccagtaaagcgattattagagccagaagataagaagccagcattttggagtaagctgttaaactccacacaaaaactatccatcgcctttgtctatgacaagaagccggatacatcaagctggttatatgcacatgaacttggcagactacatcttgaagaagtctttccagaaaaagtagaaacaagatcttatatcggagatgtggaacgggcagtgtccgatggaaatcaggttatattcacgacaacgccgcttttaatgccagacagtttaaaagcagccttaaaatatccagaggtacagattcttaactgttcgctaaattatgcatggaaatcgatacccacttattatgcgaggatgtatgaggtaaagttcttaaccggactgattgccggttcgatggcaaaaggagaaaatatcggttacgaggcagactacccgatttatggaagtatcgccaatatcaacgcatttgccattggcgttgcgatggttaatccaaacattaagatttatctgaactggacttcaggaaaagaggataaaaaaacagcagatacagagcagcttgcagttgtttccgcaaaagatatgatttccgctgacggatacaatcggcgttttggtctttattctaataagaacggtgagattttaaatatagcaactagtgttcttgattggggtattttctacgagaaaatcatacaacagatgctagatggtacatggaagagggtatcagataaagagaccgtttcaaggaattactggtgggggctttctgccggagtggaaagtctcatttgttcctcgcagatgccttatggaacaaagcgccttgtaaatacttttcagaatcttatcatggaaggaagttttcatccgtttgagggcgtattctatgataaaaatggcaaagaatacggcaaaaaggacacaatattaagtaatgaagaaattatcacaatggattggctgttctccaatattgtaggagagattcctgcaaagtatgaattaaaagaacaggcaaaaccaatcgtagagcttcagggagtgaagggagaaaaagaatgaatatccttgtgattgcagatgaagaaacgccatctttatgggactattttcgcccggaaaaattgaaggatgttgatttgattttatcctgcggagacttgaatccgaaatatctttcctttcttgcaaccttttgtaaagggccggtactttacgtacatggcaatcatgatgaccgctacgagaaaaccccgcccgaggggtgcatctgcatagaagataaaatctatgaatataaaggtatccgaattatggggcttggtggttcttatcgttacagcccgggaatcaaccaatacacagaaagaaagatgcgaaatcgtatttttaaaatgtggtttccactttggcgaaagaaaggattcgatattctacttacccatgcagcagcttatggcgtagatgatgccaatgactgggcacatatgggatttgaatgttttgtgaaattgttagacatataccatccgaagtattatatacatggacatattcatttaaattatggcgggggacatacccgcagacagcaatatggcgagacagaaattattaacggatatcagttccataaatttgaatatgaaacaggaaaagaaataaagatgttttagatacttctcgactgagataaaattctcttgcaaatagaagaaaaatagagtatcttgagagagattgacaattagaagacaggtgacaaagcttttctcataaaaataagtacagaagagctttggaagtacaataatactgtcaggaggtgtatcgttatgttaaataatttttctgtgtctgaacgaaaggtggcgattattggagcaggatttgtaggagcatcgattgcatatgcacttacaatacgcaagcttgcaagggaaatcgttttaattgatattcacgaggaaaaaacaattggggaagccttagatattcagcatggtattccggatatgggaatctcttcagtcagggcaggaacttatgcagactgtaaagattgtgatctgattatcattactgccggaagaaatcgaaagcgtggagagagccgccttgatttgattgcaggaaattcggctattttaaaagatgttgtaggtcagatgaagccttattatacaaaaggtgtgatcatgattgtaagtaatccggtagatgtgctcgtatatcagtgtacaaagtggatgggacttccgaacggaatggtatttggaacaggatgcatcttagattcttcccgttttacccgtttaattgctgattatacgcatttaaataccgaggttgtaaaagcgacaatcgtaggagaacatggagatgcacagattccgatttggagtcgtgcttcgattgcgggagtaccattacaggaatattgcgagaatgtaggtcttaagtgggatgaagagattcgaaaagaaataagtgataaagtaagagagatgggtgcaacgatcataaaaggaaaaggaagaacacattatgggattgcaacctgtgtctgctatctggctgaagccgttttgaatcagcggcttacgattgcgccggtgtccacaatgtttcagggtgaatatggcatagaagatgtctgtcttagtgtcccctcaattattggcgtaaatggtgtggaaaaacgtctggaagagaggtgggcagaggaagaatttcaggcattccgtcaggcagcggataagatgaagaaagttttgaaaacactgtaatattagttttagagttacgggaacagcttcagaattacgggagcagtagtaattcgtgacatcatatgataatatcataatatgattataagacaggaggaacaaatgagagtatcgagtgatttcagagagctggcaagaagagctctttcgggtaaatggggttcggcagtacttacgaccttagtagcatctatattaggtgcagatattgcaatggctggcggtccaagtgtatcaagagttacaaattatgtaagtaacacaatgggaaatggaggtagtgatcattcatatagcacacagttatcttccctgtcggtaactacactgacatatatttttggtgctgttatggcgattacaggtttaataattataataggattagtgcagtatgtcataggaagttttgtttcgcttggattaattcagtataatctggatttgattgatggcagagatgcagagcttagccagatcttttcaaaggcttctatgtttggaaaagcattctggcttagacttcgaatgagtattttcacatttttatggggcttactgtttattattccgggaattatcaaagcttactcttatagtatgtcaggatttatcttgacagagaatccagaaatgactgcagaagaagccatggaagtttctatgaagatgatgaaaggaaataaatggcgtttgttctgtttggaatttagctttattggatggaatattcttggggttttaagcctgggaattggaatgttatgggtaacaccatatcagaatgcagcagttgcagcattctacgatgaaatatcaagagaaccattaaattaaatacgggtttgtagatttaatgtagacgaaaaaagaaaaaacaatatatcccatctgctctgtagtcgctgtatttaagatgcaggtgagcatcttaaatacgctccgaagccgcatctgggatatattgttttttcttttttctgattatcgtaaatctatagttggcgagcatggggattgcccagaagtctatggttttcattagaatgaacatctccggaaagggatactttcttactcgattgtataaaaattatatttatctattcctaccttatggagaatttttctctgagtaactctcataatcttctggagaatccccttctctttccaacagaaatcactaatttgttatcaaaaaacagtcagccgctgaaataaaattttatgctgaattgtaagaaaactatagtaaaaaaagaatggttataagtattgcattttgtgactttgcgctgtggaattttgactctgaaaacttcggactcgtttttccgaagttttcgctttttgaggcaaaatgaagcgtttagcgtaacggaacaaaatcaaacttataaccattcttttttcgtctacattaaatctacaagttagaattacattgtttgtaaacattctaagataagcttctcaatatattttgggggctttttttcttcttcttcccacgcaagccatgtttttaacggaaaaccaagaagtttggcaacttcttctggggagcgtttggtttttattctagcttctttgattgtcataaaaatatgtttctcctataaaaatggtattagggtcaaaaagtattttgcccctttgacaccagattgcttcgtgctttgcactctcgcaatcttcaaaaacattcataatccgctcatttttctttgaaaaatggctacctacttatgtttttggcaggtcaagaagtcaaaaatccttttgcaagcaagcttgcatcgactttctgaccttttgaccttggtatcataaaaatactatacgtgggtgttgttgatttgtcaaatgaaaagtgtgttcggaaaaaaaagaaaaatggattactaaaaaataaaattattggttaaagattacaaaaaaagaaaatcttatagaataacagatttttatgaattagtacagacaattaattgttgaattataaaataaaaaaacgaacttatcatactattataaaaaaataaaatataaaaattactcgccacttacaaataattacattccaaaatttccttgttttggtataatgatgacataaaacacagagccacataaggattctgaaagaaaggaaatataactatgagaacaataatgaaaagtgaaaggcaagttgaaggaggttttaagaagtatttgttaaaatatgagcttatagcgaatgggtttctgaaagatgaaggagagggaacatattatggagtgacagtggaacagtttgtctggtcggaagaaaagagagtatgggagagatacgattcggcagaagtaacaggcttttcagaatctttaaaggaatccatgttgttttttgaaaagattgttaaaggggatgttatgccagtatgtctggagaatattgtcgatgattggaaatctgccttttgtcttgataacaaagaatctgcatagtgcttgtgtgtgatttttatattcaagtcgagcagccgcgagacttggcgcgtaattctggtcagcgtaagctgacatattctttacagaat

SEQ ID NO: 482 - DNA, 9625 bp, Eubacterium hallii
gaagccaccctatggctatagcgcggaatatgcagataacagaatatcactattctctgctcaatggggaaaatgtgctgttaccggtgaagaattctcaagtacacatgagattcactgtcatcacaaactgccccggtatcttggaggcgatgattcctatgggaatcttattttagtgaaggattctgtacacaagttgattcatgccatcaatgcagatacaatcgcaaaatatttggaactcctacagcttgacaagagccagctcaaaaaggtaaatacgctccgtgagttggcgtctctgccgttaatctaatctctcactaatcaacacaacacagtatttctatgacaggtttgattgtttagacaacgaaatctactaaccgatggaacgccgtgtgcggtgaaagtcgcatgcacggtgtgaagtgggggaaaagcctgagatgatatcaggggcttacctatcactataaaacagcgattttgtcctcatgctcaatcaagcgcagggcgaccgtactatccttgcaaagcagcttaatatttccccgcagcagatgaagtatgttacccacaccgaagcgggcgaggggcttatcttctatggaaatgtggtgctgccttttgtagaccgcttcccgaaagataccgagctttacagggtaatgacaacgaagccggaggaagtttccgaaagcggaaagtgaggtgcagaccatgaagcaatataaatcccgcgataaaatcacgcagaaaatgacccgcgacgggcttatcgaggtaaacgaaacacagcagaccgccgagcgtatcagtaaacgggaacaggacgcggattttcaaaagtccccggagcagcaaaccacacaggacgggacgcagcttcaaggtttaccgtcccaaacttccccgttaccccacgcaccgggagctgcccccgcaagggacaccgccaccgcagaccgcgtcatggagcatatcgaagccgcacagacccgcaaatccagtaaaaaggcggtacgcaaggcacaggaggaagccaccgcacaaacaacatcttcccgcttgcagtttaccgaggaagaacttgccgccccggaactggaacgctatattgaaaaatcaaacaaagccgctgaccgactggacgcggcaaaggcagctatcccaaagcaaaagaaactggttaagaagcgcacctttgacgaagccgcaggcaaggcaaagacccgcttacgctttgaagaacaggaaaaaccgatacccggcggcaaaaagggaaacccgctgtcccgccctgcacaggaagcagggattttcgtccataacaagatacattccgttgaaaaggacaattccggcgtggagggggcgcataaatcagaggaacttgccgagcgcggcgcgaaatacggagcgcggaagttaaaacagggctaccgcagccataagctgaaaccctaccgggaagcagcaaatgcagaaaaggcagcatttaaggcaaacgtcaacttccagtatcacaagaccctgcgcgacaatccgcagcttacctctaaccctctttcccgtttcatgcagaaacagcagataaaacgccagtatgcaaaggcggcaaagaaaggaggggcaaaagccgcagcagaagccacaagaaagacggcaaagaaaaccgccgaggaaacgaggaaagccgccgcatttgcggcaagacacccggcgggcattttgattgcagttgccgcgctgcttctctttattatgatttccgcagggctgtcctcttgcggggctatgttttcgggcttgacaaacggggtgcttggcacgtcctacacgtccgaggacagcgaccttgtggcaacggaacagaactacgccgctatggaaaatgccctgcaaagtgagattgacaatatcgaaaacacccaccccggctatgatgaataccgctatgaccttgacagtatcggacataacccccacgaacttgcgtcttacttgaccgccctcttgcagagctacaccccgcagagcgcacaggcagagcttgaacgtatcttttccatgcagtacaccttgacgctgaccgaggaagtggaaatacgctaccgcaccgaaacaagtaccgacccggaaaccggggaaaccaccaccgaggaagtcccttatgagtattacatcttgaatgtgaaactgacatataagccgatttccgagcttgcggaggaacttcttacgccacagcagcttgaaatgttccatgtgtacttggaaacaagcggcaacaaaccgctgatttttggcggcggttctctcgacggaagcccgtccgaggatttaagcggcgtggagtttgtaaacggtacgcgccccggaaatcaagagcttatggaacttgcaaagcagcaagtcggaaatgtgggcggctacccttactggtcttggtacggctttaacagccgcgtggaatggtgcgcctgttttgtatcatggtgctacaatcaagccggaaaaagcgaaccccgatttgcgggctgcgaatggcagggtgtcccttggtttcagtcaaggggacaatggggcgcacgcggctatgagaatatcgcaccgggcgacgcaatctttttcgattgggatttagacggcgttgccgaccatgtggggcttgtgcttggcagggacggcagccgcgtctataccgttgagggcaattccggcgacgcctgcaagataaagagctatgaccttaactatcaatgtatcaaaggctacgggctgatgaactggtaaagcagtccaaaaaagaaaggagaaatgacctatggcaaacaataaaatcgaccgtatcaataaggaaatcgcaaagacccgcgagaaaatcacagagtatcagaacaagttaaaaggactggaagcgcagaaaaccgaagcggaaaaccttgaaatcgtacagcttgtacgagctatgcgtctgaccccgcaggaactgaacgctatgctgtccggcagcggtattcccggcatgaacgccgcacacgttaccgaagcagcagactacgaagaacaggaggaaaatgcagatgaagaataaactgaaaaagaccatgactgccctttgtgccgcccttatccttatgggcggtttttctgtccctgcctatgcacagggcgcagctacagagccgaacgccggggacgcgaccaacgacagcaacgtagttgtggaggaaaaagaggaaacgccgccccttaccccaaagggaaacgctacactggttgacgattacggcggcaataagcagcttatcactgttaccaccaaaagcggcaactacttctatatcctcattgaccgcgccgccgagggcaaacagaccgtacatttcctaaatcaagtggacgaagccgaccttatggcactgaccgaaaacggcgaagctgccaaaaagccggaaatctgtaactgtacggagaaatgcgaagctggaaaggtaaacacgtcctgcccggtatgtgttaccagtatgacaggctgcacaggtaaagaacctaccccaacaccaacggagcagccggaagaaccgaaagaaaaaagcggcaatcccggtgtagtgcttgccttagtcctctttgccctgcttggtggcggcgcagcgttctactactttaagtttctaaagcctaagcagaatgtaaagggcgataccgaccttgaagattttgaatttgaggactacgacgaggacgagccggaagcagataccggggaaacttccgaagatgaagaaacggaggaagaaaccctatgaccctgtttaccgacaatccctttgaaaagatgatgatacagaaaccgaacgggcggcgtgataatgcgccgcctgttccttatcccccggcttgcgcttcctgtccttataagggacagtccccttgtgtggggtactgtgtcaaaaatttgtctttgaaaacttctaaatagacgcaattattcaaatatgataagataaaaagaaaagggagtatagcctatggagaaaaaaactttgtttgaaatacctatttatgctatgagcaagaaagaatttaataaaaggtgggataagcaaaaaaagaccttatatgatacatacattagtcatggtcattctgaggaagatacgaaatattatgtatcaaaatttagctttccacgaagtctatgggaatataatcaaattataggctatataaaaatttctgtttctaagcatgatgtttggtttgatatatattgctctcttgataaagtatattatgcagatagtaagcaaaaacattttatccaaaatattcaagcaaatggaacacatttttatctttctaatccacaggataaagagattaaaacgaaaatatttgaatggttaaggtcaatagaaagaaattatttaagaaaaagtttttatgttgattactctacttttaacaacattattgaatatatcaacattgaacaaataatgaaaactctgtaaaaaaatcatgttgatagcgacaaatttcttttagaagtttgtcgtttttttatgcctgaaaggaggaaattttatttgattttagttgtcgcagaaaagcccagtgtggcgcaaacaatcgctgccgtacttggggcaaaggaaaagaaagacggatttctcacaggaagcggctatatcgtttcttggtgcgtaggacatttggtagggctttccgaagctgccgcctacggggagcagcataaaaagtggagctatgacagcttaccgattttgccgcaggaatggaagtacaccgtttcggctgacaaggaaaagcaattcaaaaccttaaaggagcttatgcaccgggcagacgtttccgaagtcgtcaatgcctgcgacgcagggcgcgagggagaactcattttccgttttgtctatgaaatggcgggctgcaagaaacctatgcgccgcctttggatttcctctatggaggacagcgcaatcaaagagggcttttcccgtctgaagaacggcgaggaatacgacgcgctctttgcttccgcattatgcagggcaaaggctgactggttaattggtatcaatgccacccgccttttctctgtcctttataatcataccttgaacgtggggcgcgtacagaccccgaccttaaaaatgcttgttgaccgggacgcagcgattaccactttcaagaaagaaaaatactaccatgtgcgccttgccttatccggcgcggaagctgccagtgaaagaatttcagataaggcagaagccgacgcattaaaaacgacttgcgaagtgtcaaaagcagtctgtacttcccttgtgaaagagaaaaagaccgcagccccgccgaagctctttgaccttacttctttacagagggaagcaaaccgcctgttcggatatacggcaaagcagaaccttgaccttgcacaagccctgtatgaaaaaagacttcttacttatccgagaaccgacagcgcatttctgaccgacgacatgggcgacacagcggcgggcattatcaaactgctttgtggaaagttttcttttatggcgggaaaagacttcacgccggagcttggaaaggtgctgaacagtaaaaaggtatcagaccaccatgccattatcccgactatggaacttgcaaagaccgaccttgccgcgctgccggaaagcgaaaggaatatccttacccttgccggggcgcgtctacttatggcgaccgctgcaccgcatacctttgaaacggttacagcagtttttgaatgtgccggacagtcctttaccgcaaggggaaaaacggtactgtccgacgggtggaaagagattgaccgaaaatacagggcagccttaaagaacaagcccgaaacggacgaagtagacagcgacacagaaaataccttgccgccgtttaccgagggacagacctttgaaaatccggcggcaaaggtaacggagcatgacacaacaccgccaaaacctcacaacgaagcgtcgctgctctctgctatggagcgcgccggaagcgaggacacaaacccggacgcagaacgcaaagggcttggaactcccgccacccgcgccgccgtcattgaaaaactggtaaagggcggctttgtggagcgaaaaggcaagcagctacttcccacaaaggacggtatcaaccttgtgtgtgtcctgccggacaccttgacaagcccgcagcttaccgcagaatgggaaaacaatctgacgcagattgcaaaaggcaaggcagaccccgccgcatttatggagggtatcgaggatatggcgcagaaactggtaaagacctatccgtttctttctgatgataaagcgcagatgttcaagccggaacgggaagcgttgggaaactgcccccgttgcggttctcctgtctatgagggaaagaaaagctactattgcagcaataaagaatgtatctttaccatgtggaaaaatgaccgtttctttgaagaacgaaaagtaacctttaccccgaagattgccgctgcactcttaaaatccggcaaagtaaatgtgaaaaagctctattccctaaagacgggcaaaacctacgacggaactatcgtattggctgatacgggcgggaaatatgtcaactaccgcattgaactgccgaagaaaaaataactgaatagcaagcataggaaaagagtacccttttccgtaaaatccctgctttctctaccgagaacggcggggatttttgcttgttgggaagtttcccaaaccctctgaaacagcagaaaggaggttacacatggcaagtttacgggacaccgtaaaggactatcaagaagaattaagggacggtatcgcttgggtggcgttttggaaaacgggacgttcttggaacgctgaatatttccaccttgaaatgggcgactacctctaccctgaggacagaagccgcatggaagaaatcaaacaggctgaccctaccgccgttgtggtaaacggctattactccggctatcttggcgaggatatgagccttgacgagctgaccgccggggtgcgccgccactacgaaaacggatatagcaatatcggggaatttatcaaagcccacgacgacaggttgccgccggagcttatcgaggaagcaagagccgccgcccacgctgcggggcttccgttctctgaaaaagtctaccgggacggcgaagaacccaacccctatatttttgacgggagcatgagcatggaggactacgaacttatgcaccgcatgattgaaaacgaaaggagtgaacgcatggcagaaataaaaacaggatattccacatacgaccatgaccgattagacctggcagacagtatgaggatagaacgcaagctatattttgaacaggacaaagccaatatttccgggttgactgtcttatctatggaacagctacgggaaatccgcgaggaaagcgcggcggctgaacagacaatttatgaagatttgaaacagcgggcggctgcatgggaagcacaggcaggacagacccttgccgttgataaagccattgagtatgtgaggacacccgaagtcaagcataccgctaaccagtgggaagccgcagaaaatgaccgccatatcattagcaaccgcgtttatcaaatgcgctaccacatttatgagaatacccgctatgaccgggaaaaggaacaatccgttccctatgcgtggacgctctcatggaacgtttacaccaacagcccggacggttacaatcaagcaaaaatcgccggacaggaaaagaaatttgcagacaaggcagctatggaaaaatatctgaatgggcgtatcaaagcctatcagcatttatttactgaaatatcgccgcctattccgaaagaatatgcctaccatttcaagataaacgggcagcttttaccgggctacacgattgagggcgaggaacgggaacagccgaccactgaacaggcagcacccgtcccgacagagccaccgcagaacatagggcaaaggaacgagccggaacaatttgcaattctgattaacagccgcagccattttgaaacaggcgaaccgggcggcgtgtggctttccatgccgaccacaaaggagcaacttcacgaagctatgagaactgtcggcattactgctgacaatccacaggacttttttattaacggatattctgacaatgaaaacaggcatattgccttaccctatgacatggtatgcgccgctgacattgacagccttaatcttcttgcagcgcgtatcgcacagcttgaccccgcagagcttccaaagctcaacgcagccttgcagcagaaacagggatttgaaaatatcggacagataattgattttacttacaacgtggactatttcgtacatatccccgaagtgaacacgtcccgcgacttgggcgactattaccttaacaaatccggcatggtgcaaatgcccgaagaatggaaaaacggcgttgaccttgctgcttttggaaaaaatgctgccgagcaggagcagggcagctttaccccttatggctaccttgtgaaaagcggcgacgaatgggaacgccattttgaggggcgcgaattgccggaggaataccgcattatgagttatccgaagccggaacaaagcgaacaggacaagatttttatggacgcagccgccacagaacaaaccgctccggcgacagccatagagccgcaaaagccccgcccggttatccctatcgtgctgacaagcgaaaaacccgcagaaaagatgaaagagattaccgaccgtttggagcagggcattacagaactctttgacagtgaacgctacaaagaatatctcaaagttatgtcccgcttccacaattacagctttaacaatacgctgcttatcgccatacagaaacccgacgcttcccttgtggcaggatttacagcttggaaaaataactttcagcgcaacgtaataaaaggagaaaagggtatcaagattattgccccgtcgccgttcaaggtaaaacagcaaacggagaaaatcgacccacatacaaggaagcctgttatggggaaagacgggaaacctgtcatggaggaaaaggaagtcaccatacccgcttataaggtagtatctgtctttgatgtgtcgcagaccgagggaaaagaattgcctgatattgcggttgacgagctgactggggacgttgaccgttacaaggactttttcatagcccttgaaaagacttctcctgttcgtattggttttgaaaaaatcacaggtggcgcacatggctactatcacttggaggataagcgtatcgctattgatgagggcatgagcgagttgcagaccctcaaaaccgctatccatgaaatcgcccacgcaaagctgcatgatattgacttaaacgccccgaaagacgagcagcagccccgcgttgaccgccgtacccgcgaggtggaagcattatacccatgtttttataatgttgatcttttaaattattttccataaatcctcactttcttgtaaaaaagatgagcattatcagatatgctattatcaggttttcccctcgaatgggaag

SEQ ID NO: 483 - DNA, 9179 bp, Eubacterium hallii
ctttgcattcttttgtccaggttactttaaaatccacatatttctcattttcgacaccttcaccgaaaacaagagccaggtcctgtgtcccagatcctgttgtgatcttataggctgaatattccttatcaatacttcctttcatcttagaagagaaagtagcactgacatttttagcctgattgagtggtgctgtcagatagaactttgtaccatcagaaatatccacattagcccctgcagcacttgtttttccagttgtcacatttacaagttttacgcctttcggaagcttgaaagtgatcgtctgcagtttatctactttgaatgtgatcacacttgttcgctggctgtttccttccacataagcctttacattagattcggaaaaactcatatctacagacggaatgtccggcatatttacacaatagttataaagttccattgccaggttctttcctgttgcattggttccggatgcccagtcactggatccatttgcataagccgctgcaagatgcgtaatgatgaatctctttcctgctggaaaatccggatgtttctcatcacttgcttttgttccgtaatagcagacctttgcaagtgtttttccatcggcaagtttctggatcgtataagttccatttcccggtccttttttcgatggttcaacgcagtatgctgtcgcattaatgcttccccatttcacataatacggacaagtcagataaaaacctaatccatagtctgcgtaatagtaccatgcgactcctgaactaatgagctttaaattatacagcctgacaaaacgaggccaggcttatcatatgccgatggagattcagagcaatttcctggcgaaataaagtaaataaagatcctgttctatatatcataatatgaacaggatctttttataatgatttattttctatctaaaattttattaaaccgactaaagactccatagtttgtgtgtttgacttactgtttatatctatcttctcctaaatatttttctagtcattgcaatataaaattgcttatacagtctctcccttaagagtcctggtattctggataatatacagagcgaccgatatgaccatcattatagcgcacaaaccaatcaacagatctgataccatcggtgtaatgtggaaccatataatatgcaccgctgcagttccatataataaaaaggttactatctttccatgccagtctgcaccatgtacttttcctgtcttttgtatcacaagacatccactgactaccatatacagctccttacctgccattattgcgattaaaagaagcacatgcggaaaacgagtaaacagacagattaacatcgctgcctgtgtcagcttatcagccaccggatcaagtatttttcctaaattactaatcctatggaatcttcttgcgatatatccatcagcaagatccgtaagaccagacagcaataagatttcaccagctaacagaggatttttctttacacaataactccatataattaccggaatcagacaaagccgaaaaaaagaaagaagattaggaaccgtaataattctattcaaattttcttcctgattcacttcactctgcatgtacggtcacctcactttcctttttttagacataaaccaataaaatataacacaaaatgctaaagcaaacactacaccaaaaacattttgaatcactctaagactaaccgctccttgtagtccataagtctctgcagcaatggctaaagcaccaaatgtgttaaatactgcctgccagccatattgtgctgaaaatcctacaccgattccaccaagaattcctatatatgcatagattgacgaaggaagcagaaaatataatactgtaaaacatataacacctgcaatatttccgacaatccttttacggactctgtagtgcatatcttccataaacggcaaaatcgcagacatggccgcaataccagcccacattgcacgtggcatattacaaagttctgcaatgcaaaggacaatcggtacgcataaaatctgacatatctgccattttgttctggaagaagtgatatcaaattcttgtatcagatctttcagatttcttttataagttctgtttttatgatttcgataaaatacaaagcaggtaagtgctgcacctaaagccattccgactaatcgcatctgatagctttttcccgtaacatcataaccatatagcagcagatacccaagaaccaatgtagattgattaaacatgaatggattatggcatccgaacagaatcaacacagccagtgccgcaatatttaacagcattcccaataccggtgaaaactgatttgctaaatgcggacatacagtcataattacaaagaacaaagccaaaagcatcgtagattgtccggtgtggatccccagatccgcatttctaaacaccatgagacataataagactactacacctacaatgctgttctcatttccaaataggatgctgaaaatactaacaaagaaaaaacaaaatgccattgtaacagctatcttcaccagatatacccacatatgatataatttttcttttagtgtttcactctttttcaacagttttttagaacctgcctgatttaactgcaactcctgataaaatgtcatataaatcctcccatcttctaatttatcttaaaactatataatctcatctttctgctttggcagctctataacaaatctgcatccaccatattcacggttttctgctttgattgttcctccggcactatctacaatccgttttacaagtgcaagacctaggccatttccttctgctttatgagatccatctacctgatagaacttgtcaaatattctggattttacatcatcctctattcctggtccttcatcttccagaatgaacttaacagaatcctgttcttgtttcagaaacatcgtaattgtcccctttgaagggctgaacttaatcgcattatccaaaagatttatccagatatgcataaaaagtccttcattcccagtatatttaacttcctccaattctacctgaaaaccaatttctttttctgtccattttgtttccaatgaaagaaatgcctggcggatctgttcatccagacgatattctgtttttttcattggtatattctgattctctaacttggataacagcaaaatattaccaaccaatccggaaagtctttgggtgttaaataagattttttctacatattcctcttgatccggagacagttcttctccctgaagcagcattgtatatccttcaatggcattaatcggggtcttaaactcatgagaaacattagatacaaaatccatctgcagcacctctgttgcacgaagttcttttgtcataacgttaaaactttgataagattctccaacttctgctatacggctgttcgtttccaaatgctgttcaaaatctccctgagaaacttccttcattgctttactaagtctggtaattggttccagtaactttgcattaataaaggaagtgatcagccctgcaatcaatgtattaaaaatcaaaagccagccaagcacaggtattctgcccggcagattaaaaaaatgattcaaaaaagcaaataataaagcagatatgactgttgaaaatacaagtgccagccagattgcaccagtcagacaggatcggatccgcaatcctttttctttcttttgttccattattttttcaccaccttgtatccaattccacgcattgttacgatttcaaaatcagggttatctttaaaacgctctctgattcttcctatatgtacctctatcgtatgtgggtctgcctccgtctcgtatccccatacttcatccatcaactgttgttttgtaaatgttctgcctggcgaagctgcaagcttatataaaagcaggaattcttttttaggcaaaacaagactttccttatcagttgtaaccgtcattgcatcataatcaaactctgttgaaccgatcacaattttgtgttcattcagtatctgtgcacggcgaagcagtgctccgactcttaaaaccatttcattcacatttaccggttttaccatataatcgtcacttcccgaaagaaatccctggcgcatatcatcaaaggaacctttcgcagtgatcataagcactggtatctgatatcctgctgaacgaagttctgacaccagttcatagccatccataaccggcatcataatatcagaaatgatcagatcaatatattccttatccaatacttctaatgcctgtgctccatccgatgcacttttgacttgatatccattcttctcaagcactttttggaatagctggcttaattctttatcatcttctacaatcaatatttgaaacacgttttccttcctccttattaaaacagataccttgcccatccaagcagatgctgtaccaaaaatatttttctctgacgtttctttgttaattcgattggctctacatgatatggatcattataagttccgccttctaatatctggcgggacactttttcatattccatcatgccctcttccaactgtttattaatatctttactgcgaattacaagcatcagttccgtatccagatatgcacttctcatgtccatattaaaggaaccgattacagacagatcatcgtcaatcagaatactttttccgtggtatgaataaccgccttcatattcccagatattaattcctgtacttaagattctatttctgtttttcgcataatcggcagccccaaatggattcccattattcgcaactgaatttgtcatgatagaaaaatctgaaacgttctctgcaatctcctcccatgtattatacatcatatcattacagataatatatggcgtgtggatcttcacacgattttttgcatttttcatcaattctcccaactgataccacactactggttctttggaacctgtgtgaataggatttgacactaatataatcttttctgtctcaaaagtttcgtccgtataattggtctcgcagattctttccttattctcttcaaaatatttctgatagctgttctgcagctctaaaactgcgttctttacagattttctatttgccagttttttattgttatgaaaataaccactgtcttcctgattccatatggtttcaaaatactctgacaactggttaactgaattttctttctcaggttcatcgcaaaccactaacacgtctctgtcatagttcttatgtcccggaaaatcacccaggaaataattgtatgtatttcttcccccaagaatatatctctttccatctgcaatcaaatatttatcatgcattctacccatcattttccacggtttcaacggattggccttattatacagtttaatttcaacattctcatgggaagataatccatagaaatacggatttccttccatatcaatccagctctccattccatctactaacagacgaatatgtacacctctgtctgccgcatcatgcagtgctcctaaaatcaattttccactttcatcggattgaaatgcaaaagtagaaagaataatttccttttttgcattcttgatcaaacgcactctttgtaaaagcgcttctggattcttttctatgattactgcccgttctgtattttcactgcattcgttccatgacccattttttgtttcttttttggttgtattggacacttccggctgctttttatatgcaacgcagattccgagcaattcataaaaagccacacataaaaaaattgccagtataacaagaaggattttacatattttatgctttttcattgtacatcacctgattcctttttatttcatacttatacaatacaaagtcaacctcaatttaacctcaacaaaatttatttttcataaaaaaatatgaccggcttctttttaaagaaacagtcatatttttattctaatatatgaaggagcttttcttactccgttgtattaatcactattttatttcttccataagctgtcggatttttctcaatgtacaccgtgtaactgccaggtcatcttcttgtatattcgatatgattttttcataagcttctatcattttttctttctgacaattacttaattcaattgccttgttcgtcaaaacaaggtatgttctttcttttttttcatctaatttccagataatatatcctttattttcaagactttttaccatcttagatgtttctggaatcgataatttcatgtattctgccacttctgaaagatatactccttcatgacagtctgatttttcaacacattcctttatactataaagaaacaaataatctgttctttcaacaaattcaaatatactttcaacattgatgctctttaaaaaaaactcctctgcactggttcctactcccatattatcgttcctctctttctatatattcttttttgctgactagactcttatatgccgggcgaatgatcttatctgtagttatcaattcttccaggcgatgtgcactccaaccagcaattcttgctatcgcaaataatggcgtgtacaattctcttggaatattcaacatgtcatacacaaaaccactatagaaatctatattaggacttactcctttgaatatctgacgctgctttgcaatcaacttaggtgcaatcttctcaatattgttataaagggtcatatctttctcacgtcctttatcccttgcgagttgttctacaaagcctttgaacaccctttctctcggatctgaaatagaatatacagcatgtcccattccataaataagtcctttctgatcaaacgcctctttcttcaaaatcttactcagatatgatgcaatttcttcttcgtcttcataatctttcacatgacttttaatatcatccatcatattcattaccatcagatttgcaccgccatgtttttttcctttcaaggatgacattgctgctgaaataacagaataagtatctgaacctgaagatgttactacccgtgtagtgaatgtagaattgttaccaccaccatgttccatatgtaacaataatgctatatccagtactcttgcttccagttctgtgaattttgtatctggtcttaataggcgcaggaaattttcagcaatagataaatctttttcaggtctatgaatatacatactttcgtttttttcataatgacaataagcatggtatgcatatactgctaacataggaaatgctgcgatcaactgcatactctgccttagcacattcggaatttcaagactttctttctccttatcgtaagagcccaatgtaagaatacttcgagtcatagaacccataatatctgatgtaggtgctttcataatgacatctctggtaaagttagtcggtagttccatacaatcagatagtcttccctgaaattccattaactgtgtatcagttggcaattctccgaataaaagaagatatgctccttcttcaaagacaaacctttttcctttacttcctgttactaaatcttttatattataaccacgataagataactcgccatcacatggactctttactccatcacgatattcaaaagcttttatatcagaaatatttgtaagccccgtcaacacaccttggcctttttcatctcgtaagcctctttttacaccatactctgaatacagattcttactaatgctatcattttgttcacaaaaaattgcttgctgtttcatataattttccaaattgctcatttgaatcgctcctttcattctgttacgaacttacatactatactcagatattcttgtttccagagcattcagcattgtctgttctttttcttattcattagcaatacaatacaatggaaaactcaatttaacctcaacaaggtttgttttttcatccatgcaaaatcttctttgtacaacagactgttagatatagcaaaaacggcctttcaaaaacagttaacttctaaatcaactgttttttgaaaggtcgtttcatcagattcttatagcaatccagcaaataatctcataaataattgtcccagtcgcaaatatgcacttcgtccggtttgatattggtctgtcacatcacgacattctcccatcgttcttatcagatcattttttatttccacaactgcctgacaatctgccataaaacagccgttttcaaaatggtgatataaacttcgataatccagattaattgttccacaagttgccatacagtcatctgccacactcatttttgcatgacagaaaccaggagtccactcataaacacgaacaccatgtttaactaatccatgataaaaagaacgagttatattataaatgaattttttatcagggataccaggtgtgataattcttacgtctacccctcgcttagcagccagacataacgcatgcgtcatttcatctgttatgattagatatggagtcataaaccaacaatatttttcagctttatttatcatactgatataaacttcttctcctacttgctcattatccatagggctgtctgcataaggttgaacaaacccagtttgctgtgccgcataatcatagtggaaaaggtatttactaaaaccagaatcattagcatccttatcacttactgcattccacatttccaaaaatgtcaccgtaagcgactgaacagcatctccttctaaacgaatacctgtatctttccactgtccatacgggtgtgtgtaattaaaatattcgtttgctagattatatccacctgtaaatccgacttttccatcaataactgttatttttctatgatcacgattgttcaaaaacagatttaaacctggcataaacggattgaatacacggcaatgaattcctattgcctccatctttttcacaaaatctgtgttaataaagcctatagaacccatatcatcgtagaatactctaacttccacacctgcttttactcgctcttccagaacatcttgaatcttatgccatgcttcagcgtcttctatcgcatgatattccataaagataaacttctgtgctttctccaaatccttaagctgtgcctctaatcctttcactgcttcatcaaaatac

SEQ ID NO: 484 - DNA, 8937 bp, Eubacterium hallii
atgtagatggcaaagaagagagccgtaaaaaagtaaaagaaaaggtaatcaaagagcctgtttctaagattgttacagaaggcacaaaagaaaaaccacagcaatcttcacagaaatcttctggttctggaaaacatatcgtttcaaaacgaaaagtaccggactgtgatggttccggtcatggctactgggaaatcaagtattcagacggaacagtagtaacaaagaattattaaacacaaataaaacgaataaaaaagtcattatgtaaaacagatttacagcactatgtgaggatgcctgccagcagccttcatgtttacggaagttgaagttttatataatggcttttttattgttcacaaaatgttcacaaaattttagcactcaacacttgacatggctaataatgggtgttatattacagctagaacaaaggagaggacataaagagataagaagataaaaaaagaagttccgaaccgaagttcataaaattcatttcaacatagtcgaaagaaagaagcttccgatttgctgaagacagtttaaagatttcgaaaggagaaatgacttatgatgatgcctagtatttttggagagaatttatttgatgattttgatagctggtttgacgcaccggttgagaagagattttttggtaagaagaatccgttatatggaaaacatgcaaagaaccttatgaaaacagatgtaagagaaaagaaagatagctatgaagtagatattgaccttccaggatttaagaaagatgagattaagctggaacttgagaatggatatcttacgatttctgctgcaaaaggtttagataaagatgaaacagataaaaagacaggtaaatatatccgtcgtgaacgttatgccggtaacttatcaagaagcttttatatcggagaaggtgtaaaacaggaagatattaaagccgcattcaagaatggtattttgagcattaccgttccaaaagaagataaaacagccaaggaagagaagaaatacattacaattggtgaataattgataagataatcttagaaaaagataaatcagaatattaatacatggaaaaataacagatacccatgaggtatttgataagatataggtaatatggattataagaaaggcgaaatatagtagcctgaatatagagattaaaatttagttttgaagggagaaatgacttatgatgatgcctagtatttttggaaataattttgtagatgatgtatttgatgatatgttcccattcgcaggtaattatacaactgctaactatgatcttatgaagacagatgtaaaagatgccggagatcactatgaactcgaaatggaaatgcctggagttgaaaaagaaaacatcaaagcagaactgaaagatggttatctgacagttactgcacagcagaataccaataaagatgaaaaagataaagaaggtaactatatccgtaaagaaagatacagtggaagctgccagagaagcttctatgttggtgaaggcgtaaaacaggaagatttgaaagctgcttttaataacggaatccttacggtagcagtaccgaaagaagttcagaaaccggtagaagaaaaacaatatattacaattgaataataatttattcagaaacgaatagatagaatctgaataaatagaatgaaaaaggtctggtgatcgcagatgcgattaccagacctttttctcttttattttaaaactttggaaagtatagttttagctggatgttttagtttttcttttaaatcggatatagtcttactttgtgtctgagaagcttgttcaagatgaataattcgctggcgaagttcctcattttcttttctgatagtaattgtagtatgaccaagcaggcgaataatatcttcactcatatgttgagaattccattcccattttttaatattttcaaagttgattttgaatagatcttcagatttatgaaaatacttctccatgattttacggtttccggcacgatatttttccataaaagcccgagcttcttccggttgaaacatacataatttttctttgtccgggtcttcggaggtaacttcagaaagcatatggtaaaagaaagtataatctttctggctggcagacggaacactattgaggattcgttgtatttcattcgtattcccgctaagacgagcatttctttcaaaagtgctaatggtatattcgtctgttagagcaagtccaaagatgtccagaaaatcatcataaatagaatgatttttaaaatatctttttccataacgtcggacgataatattttcacttcctaattcggcagcgatttcatttagtccttctgcgtaattaagatatactgcggaaggagtagtatggataaattcttcccatgtcatagagcaaaatctttttttagatttttttattttttgattccacatggcatttaataaagcatcttgtcgtctgagataaacgataatttttattttaaatgcattacggagagattcctttcgtaatgtttcccataagtctctttttttaaaatgtgcggcataccaaattccttcatcagagaggagaacattatcatatttagaaaacatatgaataatgtgatccatgttaaagcgaaaaagccttttttcttctaatatatttattttaccatttttaccatattgtggcgcaataagaaaatgtgcatttcgaaaagggtttatatcaggataagtttgttcaaatgcaggaaaataaaccccatgttttgcaaggttttctttattttcgttgcaaaaatattgaatggaagtagtggcagtttttggacagccgatgtgtatatataatgttttcatgatatcctcttttcttaaagtttttttgtaaacgaaaaagagaatatcttaaaaacattaaaattaaattaaaaagcttcctgtgaccgcatattagaaatagctgcttctttggggagagaaagtgtaaaaacagagccctcattcactttactttttacagatattgatcctttatgcaattctgtgattttctgtaccagagaaagtcccaatccaaagcccggtgtattcctggatttatctgcacgataaaaacggtcgtaaatgtgcttctgtgtttcttcgtccataccacacccatgatcttctatttcaaaaatagcaagattgtctttttcccataatctaagtttgacaaaagactggttttcgctatatttcatcgcattatttataagatttttgatagcgatagccataaggcttatgttcatgtaaatagatatgtttttgagatcatattgaacagatatttgtttttgcatacgaagtggttctgcctcacaaatagattcaataagatcttttaaacaggagtattcaaagtcttcttttattctcccctgttctaagcgggaaagttgaagaagctgagtaataatttcatttgtttttgcattttgacgtgcgattacagtcagggaatccatataatcgtttattgttcccccatatttttttaaatactgacattctgctgatataatagatgcaggggttcgaagttcatgagcaacatcagaggtaaattgctgttgttgatgaaacagatcttctaatcggtccatcatacgattatttgcctgaatcatagcatccatttctttaaatgcagtagcagattcaatacgctttgcaagattaccttcgataccgatagtatcagcagtatcttttatttctttcataggaattgtaagtcgggaagagacagcgccgatcagtaaaagaccaataatactgattacaaaagtaaaagtataggatatgtatttcatagcctggtattggctgttaaaatccgtttcttttccaatgtttcttataataacaagaatttgcttattagtaatgatgtctttttttaaaaagggccggtcaaaaatataataatatccagaggaacatttcactcgcctaaaatcccactgatttagaggataattgtttaattctttgtctggataatgaccgcggattgttcggcccttactatctaaaacaagtttttgtacatgattttcccggaaaataaaatttttgtctactaaaattttcccatttcggacttcaacgttaagaaaatcataacggctttcccggcggatctgccttctgatatcaaagtaaattgttttattggaaaaatatgaaataaacagtatcattatagctgccataatcaatataattgcggcaaagcgaatagaaatatagtgagtaattgattgtttttctttatggttcatagcattcccttatctttattattgttcaggagattttagcatatatccgattcctcgaatggtttgaataagttttacatcaaaatcatcatccactttttttctaagatatcgtatatatacatcaataatattggattctccatcaaagtcaatcccccaggcattagattctatctgtgagcgggaaagcgcgatatttttgtttcgcatcatatattctaaaatagaatattcctttggagaaagctcgatgaggataccatctcgcgaaacagatttttgatcagtatctattatcagatctccacaggaataagaagtactgtgtttttgaggacagcgctttataataacgcgaagccgggcaagaacttcatcaaaagaaaacggtttgacaacatagtcgtctgcaccataatcaagccctgttacaatatcgttggtctgatcacgcgcagtaaggaacataacaggggtctctatttttttattccgtatatcttttagaacctcaaagccatcttttccgggaagcatggcatcaagtaaaatggcatcataactttcttctgtaatataatataccgcatcatttccattaaaacaggaatctacgatatatccttctgctttaaggtgttttgtaataatgtgatttaaatccggttcatcttcaactacaagaattttcataagaatctcccttcatatatttatatgttccgcgggtcctaaagacaaatcccttaacgtgcaggcacgaacggagttttgacctttttcttttgatatcatagcataaaaatattaaagcaggattaaaaatattataagagatatgtttttggtgcagaattcctctatatttcgtattaaactaagtgatttataaatgaaatatatgtaaaaatcttgtaatgaatgtaacgctatgatagaataaatgaactggaatttaaaagaaaagtaccgagagtatataaaaatttattagggaggtataggaaagtgatgaaaggcttgtttatcattaatccatcttctggaaggcagaattttattgacaaaattaaggagattgcaggaatgctggtcattgaccagatatgtaatacaatagatgttttctatacagagaaacaggatgatgccttgaataaagcagccgcactggaaaaaggccagtatgactttgtcgttgctgttggaggcgacggaacacttaatgaggtaattaatggagtagtaatgagtaaaagcgagactccggttgctgtcatttctgcaggaacagttaatgatttcgctacatatttaaatcttccgcaaaccccaagagaattctgcgatatgatagcagatttccaacttaaaaaagtagatgttggtaaagtaaacgacaagtattttattaacgtagtagcagcaggtttattatcggatacaggatttaaggtatctaaagataaaaaagcagtaatgggtaagttagcctactatttagaaggagcggcagaacttccgaaacaattcggaaaaagctggaaaatgagattcgcaacagacgataagacaatagaagaagaagttctcctatttatgattgcaaactcacagagtgtaggcggatttagggagattgccccgctggcatcagtttccgatggtttatttgatgcagtgattataaagaaaatggatatttttcagatgcttccattaatgatatctatattacagggggatcatgtaaatcatccggcagtagaatatattcagaccaaaaaacttcagatagagaatttgtccggagaggaagtaaaagtagattacgatggagaagaattaccggaaggcttcccggtaaatatcagtatcattccacaggcaatacaaatcgtggtaccgggaaaataaatactaatttgagggactaaagaaacgaaaactagaaatttgagatagaagaaaatgtgaagatagtcgcggcgtagaaaatgcctgtttggcatttttacttgctccgacatcacattttcttctatctcaaatttttagttttctgttctttggctccagaaggaaattagtatttggatttgaggaagaggggattgtccagaagtctatggtttttaatcagggaacggtttccacataagaaaatattcttcatctggagccttttttcgtctatacaaaatctacaaattagtacttcggaaaaacgaatccgaagttttcagagtcaaaattgcacaacgcaaagtcacaaaatgcaatacttataacaattcttttttctttatcatagtcttcttacaattcagcataaaattttatttcagcggctggctgtttaataataaataacaaattagtgatttatattggaaagataacaatttgaatgtcaatcctttagaatttaattttccggaagaccatagccttctggcacactccatgttgttaaaccgtagatttagatagtcagaaaaaagaaatactggcatatcccagatgcggcttcggagcgtgtttaagatgcgaacgagcattttaaacacagcgactgcagagcagatgggatatgccagtatttcttttttcgtctacacgaaatctacaaattagtattttagaaaataatagttgcaaagaatttctttctgaattataatagacgagaatatagagttgttgcgttgagagaagctacggtatggatgtttttaagagagttgatggttggtgagaatcagcaggcggaagtacctttccactttttgagcattgacgaaagtcaaaggctggtatcctttaacgtaccgatgagaggctgctatcgtttttcatatttaagacagggtcgtttgatgtatttggatatgtttatataacagcaatttgggtggcaacacggaattcttcgtcccatgatgtagggtagaagggttctttttttattttagccgagagaattcccgcttctataacaccctgatattttacgatacccagaattttttttaaataaaacaggaggaatattgataatgttagatttaaaatttgtcagagaaaatccagaggttgtaaaacagaacatccgtaataaatttcaggatgagaagcttcctttagtagatgaggtaattgaattagatgcacagagaagagcaactcagcaggaagcagatgatttaagatcaaatagaaagaagatttctaagcagatcggtgcattaatggcacagggtaagaaagaggaagctgatgctgtaaaagagcaggttacgaaaaatgcagaacgcctggcagaacttgaaaaattagaagcagaacttggggaaaaagtaaagaaaattatgatgattattcctaatatcattgacccaagtgttccgatcggtaaagatgatagtgaaaacgttgagattcagaagtatggtgaaccatttgttcctgagtttgaagttccataccatacagatattatggaaagatttgatggaattgatttagatagtgcaagaaaagttgccggtaacggattctattatttaatgggtgatattgcgagacttcattcagcagtaatttcttatgcaagagatttcatgattgacagaggatttacttattgtgtacctcctttcatgattcgcagcaatgttgttacaggtgttatgagttttgccgagatggatgcgatgatgtataaaatcgagggtgaagatttatatttaatcggaactagcgaacattccatgattggtaaatttattgatactgttttaccagctgatacgctgccaagaacactgacatcttattctccatgtttccgtaaggaaaaaggtgcacatggtatcgaagaacgaggagtatatcgtattcaccagtttgaaaaacaggaaatgatcgttgtatgtgagccagaagaaagcaagatgtggtttgataaattatggcagaacactgtagatttattccgttctatggatatccctgttcgtacacttgaatgttgttccggagacttagcagatcttaaagtaaaatctatcgatgtagaagcatggtctcctcgtcagaagaaatattttgaagtaggaagttgctctaatttaggagatgctcaggcaagacgactgaagattcgtataacaggtgaaaaaggtaaatattttgctcacacattaaataatacagtagtagcaccacctcgtatgttaattgcattccttgagaataacttaaatgaggatggctctgtaagaattccagcacctctccgtccatatatgggaggaaaagaagtgttaaaaccaataaaataaatactgatctgtagatttcgtgtagacgaaaaaagaaaaaaataatacatcccatctgctctgtagtcgctgtgtttaaaatgctcgttcgcatcttaaacacgctccgaagccgcatctgggatgtattatttttttcttttttctggctattctaaatctacagttggcgagaatgggggattctccagaaggttgtggtttcccaggaaattaaattcgaaaggattgac

SEQ ID NO: 485 - DNA, 8762 bp, Eubacterium hallii
cctttgtacagtctgtgatatatggaacgaggcttcctacgtcaccttttaagaatccatacatgtctttatcatcatcgtaggttgcgtatttatctccgtctgaaatttcagggaattccatgtcgccctttccgtatgtgttatataatgcggaggcatacatattcgttgtgttctctttaagatagtagaaggagtcttcttctacgccatctccgtatgcggattctgtttccattaaagatgtgagaactgccatggaaaaccagaaggaatctgcttcttcttcgctcgtatcgttcgtgtaatatgcatagcctttcgacagcttctgtaccattaaagcttcgatcggatagatcatgttgtcgaagttatcaggaagtgtcacatccgatgctacgtagtctgctgttgtatttgccttactttctgtcgttgcttctgttccctgttcactcttagctgtgttgttcttcttcgcatccttactgctagaacatcccgcaacacctgctaccatcattcctgctaatgctactgcaagcactcttttcagtttatttttaatcataatatcgttcctttccgtaaaatattttcatggaaataatagcgcacttaaaaaaaattgtaaaggtatttctctttattttctttcttggcttttacgctattctgattttacgaatgaatagaaaacaggcaaaggaatggttagttcagttcttcggtatagatttcatatacttcactctgcttactgagttttagtaaggtatctttatctgcgatcgttgtaaaaccatatattttaagaccattctttttgacgtaggatgccatttcttttaatgcttccggcgagtaatcatctcctgctatcatttccagaaactgtttctgatctgatagataattaagaagacttacaaaatgctgtctggcatagttttcttttttgagattgttttctacgctgtcccagtgatctggggcatccatttgatctgtttcacatcccggcagaagggccggatactttttatcgtcccagttaaaggcggcattataagatggtacgcatacgaaaccaatatttactgcaccggagaggaaatccgttatatactcttctccagtctctgctttgtccttgtttgaagaatcgtcagcctcttcaagatcttctttatctttctgtggttctaatacctgtactgcacaccatacttctgaaaaatcctgcttatctacgtactttttaaaatcagcataaggcatgatcttatctagagatatgtaacctatatacattttttgagaatccagattttttaatgattctatagattgttcttttgtaccagcagcgcacatattgacttcttcgttctctttcagttgaaaatactttctggtacattgtaaattctcttctaatgtattctcttcttttccaacaaggttactgtatgcaaaggcattgctaaccggtgtttttaaaatattattgtcataatatctcagcttgccccggacaatctctccggatacatcggttaggtttcttgtaaagctcgaagtctggttcactgtaatattatactttccatacccttttgattctgcttcaacagaaactcttctctttcccggaagaaagacttctgagtatactgccatatcacgactcatcttgtttatcgtataatccttattcccgatattttccgctggattataatagaaacaggatactatggtcggaaagcagaactgtacaaatagaattaatgcgaacgctaaggcgagaacggttaaccctaatcttcgaaatgcccgtctgatggaacgattgatcattgtgataaattctgtatcgatatcctcttccggggtacttcttcttttcttgttcttccctcgctgacctctcgctctttgttcctgagcatcagcttctgctttctctttccctgtctctgtctgccttccatctgcaaaaacgaagctgttccggtcttcttctgcaaaaacgtcttccaaaccgggaatttcttcctgttcatagagataatcactgattgcttcctgcttctcgatatctttctcgatccgctttctctgttctaattccagctctcctgctttatataattctaataattcacgataggtcatcttccttcctccttcgttaaatattccttcagttccttcttcgcccggtaagagagaaccttcacattacccggagtgatcttaagcatcgccgcaatctccttctgtgaaaagtccccaaaatactgtaataggatcacttcctttttctgtccctttaactgacttaccgcttctaaaagctgcttcttctcttctttatgaagaacttcttccagaatatcactctgtattaagacttctcttcctgatgtatgtacctccatggctgcatgctcaaaatcagatgattcgatcgtcatctgcttcttctgcctgttataatagttatagtaaagattacgcgctaccatataaagccatgcccgcatattggtatgagaatccttcaatgtcagtaatgcttttaaaaaggtgtcctgcaaaatatcatctgttacactctcactggcacaaagtgaaaagacaaaaatatataattctttataatatcgctgatacaatgcttctaacaaatgtttatccagattcgcaccccctcattccgatacttttcgacttctttcatctatataacaattaaataagaaaaaggttacactatttatttaaaattttagaatttattcacatacaaaaaaacaagaactctattacataatccatgtaagatcaatgcaggtaaaaatgctgaaaatacggatgcggcatttcctaatgctgtgacgacctttacatgtatcatgtgatagagttcctgttttcgttttttctgttttcgtttttctattcagaaatgaaatcgcaaaatagtgcttttatttgttttctggctgcctttacggaaccttgtgcaaagaatggtttaccgccgccgcggccgtttaattctttgttcaccttttttacgagttctttaatgtccccgttccgttctccaatggcatatttatatccgtctgtgtcgttgccggcaaagagggctgctatgccgccgcaggtgtttaaaatggaatcggtgcactttctgacttctgctgcttccattgtatcctcgatgaggagtacattgcctttcccagcaaaggaagctgcttttgcctcaaagcttttttgtttttcctgtgccagttgtccttttagatcatagacttcatcaagcaatctctgtaccgcttcttttgtttcattctcctttacggaaaggctgaccgcaatctggctgttttgctctgtgctgccggacagatagtctaaggcacgtttgccggaaagcatttccatgcggacaccatcccggaactttttgcaggaaagtatcttaacgagtccgatctggctggcgtgagtgacatgtaagccacagcaggcacaaaggtccgctcccgggaattcgactaaacggatttctccggttagttcttttttactgcgatacgggataaacttgcgctggcgttcgtccggatagaaaatattcaccttctggttcatccagatgtaatggtttactttcttttctatttcctgtacctgctgccaggtgagcattccgctaagatcaattgtgatgatttcttctcccatatggaaaccgacattttcatagccgtatttctcatggatcattccgctgacaatatgttctccggaatgttgctgcatcaggtcaaagcgccagttccagtctatctttccgatgacctgtgcgccttcttctaatggactttccatgatatggcagagttccccatcgatatactgcacatcatctaccggaatgttgtcaatcattcctttatcggccggctgtccgccgccttccggataaaatgcggttgcgtttaaaatgacgtggtattttccatctttttcttcgcaggaaaggacaatcgcctcaaattcctggatatatacatcttcataaaataatcttcttgtcttcataatcctgtctgttttctatttagatgatgcggtctttacatataatgaaagatcagtttccggattctgtatctgcatctgatactccgtaaattccttgttaccattttcgtcttcatatactttataaccttcgtgatctagtacagtaaagtatacatctacagggatattatatgtgtattcctgattattctctccgttataatcggagtatacggtacatacccgcttctctttttcaagcttctgataaaataccggaactttcttctgtccatcaaattctacgttatatccgtaaaatacttcatctccacacttctcttctacagaagtaacgatctgtgtctttttatccatggtgatcgtcttctcaatcgtatcgccaacagagaatccgtacgttgttgcgtactcatcactggcctgtacctttgttgtaagctgtaaggtgatggtattatcacgttccttctcattctgcagctggtctttcgtatctccctggaaaacgctgtcttcgatgctctttacacatttctgctcatagtcatctccgatcagtccataatactgtacatacttatcgttataacggtataattctttatttgcgattacttctttataatctgcatcggttccttctttcttaaagtaagagaagtagttgcctttcttatcctttcttacctgacgggttgttgtataatctgaaccttctgccaaatgagaataggaagttgtgatcgttacgttcttatggtcttttaataaagcctcgatgttattcgctgcattgatttcttccatgtgctttgcattcttatgtgttttatgcagcacaccaaaaacaacacctgcaagaataatgatcgtaagtaataagctaatgcctaaaactttccagaaccatggttgatttcttcttcgtcgatgagacgaattactgtctaagtcatagcctttatatttctgtgcatttgtagtatccgccataaataaaaatgttctcctttctagttttatgtactcctgctgtatctttccaggcaagaaagaattcaaaagtacacttttatatgctctgacgctcttaccagaaagaagtcgtcaaaggccatatctgccttattataaatcaatctttagtcatatttcaagttttttcaatctttttgtatatttttcattaacatatagctgattccgtttgtctggttctcttttttctcttcatcggtcagtgggcggactacctttgccggagaaccaaaagctaacattccatcaggaataacggttccctgtgtgacaagacttcccgctccgatgatacagtccgaaccgattttcgcaccgttcataacgattgcgcccattccgatcactgtattatggccgattgtacagccatgaatgatcgcattgtgaccgatcgttgtgccgttgccaatctcgcatggaaagcctgtatctgcatgaacaactgtgccatcctgtacatttgatccacagccaacaacgatcggtgccatatctccacgtattaccgcattgtaccacactgaactttcatcccctaatgtaacattacctactacacatgcaccaggtgctacccatgcatttccctgaatatctgcatttttaatataactcattttttcctcctgttttttgtataattgttttggcctcagattagaacatactcagatcatgcggaaccttgtgtcataaagaaatcaaatgtaagctgatcggtttccggtaatccggtaaggatgccaagttccaccatcttatctacgtttgtcttgctgacttttgcctgatttctaaagttttcaagggaagtaaacggtccatgctttgccgcttcctccacctgctcacatgccttgtcgccaagtccttccacactagaaagcggcggcatgatcttaccgtctataatctgacattctcttgcttttgctttataaatgtcaatcggcatgaatgtaaagcctcttgcatacatttcctgcgcgattcttccatcacgaatcgtatcctggtctttcttcgtctgctgatctttcggtgttttcagcagttctgaaagtgctatatctaatcgttcctttcctctgcacatgatctcataagaaaatgcggatgcacgaataccaaaataggcggcataatatgccagtggcttatgtactttaaaccacgctacacgccatcccatcataacgtaggcagcggcatgtgccttcggaaacatgtatttaatctttttacaagaccagatataccagtccggcacgccatgagaagtcatctcttcttcccactccggctttaacccctttcctttacggacggattccataatggtaaaggactgctctttatctaatcccatgttgataagataagtcataatatcgtctcgacaacagattgctgtagaaatctctgcttttccttcttcaattaatgtctgtgcattgccaagccatacgtccgtaccatgggacagaccggaaatacgtaccagatcagagaaacactttggattcgtatcttttaacatctgcataacgaattctgtaccaaactccggtacaccaagagaacccatctcgattccaccgatatcttccggtgtgattccaagaatatcggtgctgtggaacagcgacataacttccggatcatcgagcggaatcgttgtcgcatccattcctgttaagtcttctaaccgtcgaatcattgttggatcatcatggccgagaatatcaagctttaataagttatgatcgatggaatggtactcaaaatgtgtcgtgataatatccgtatttacatcatttgccggatgctggattgccgtaaagtcataaatgtcatactcatgtggtactacgataattcctcccggatgctggccggttgttctctttactcccgtacagccttccgctaaacgctccatctcacatcttcttttgtgaatatctctttcttcaaaatacttgtatacatatccataggctgttttttctgcaagtgtaccgatagttccggcacgaaatgctttcccttctccaaaaataacttctacgtatttatgcgcttttgactgatattctccagagaagtttaagtcgatatccggctctttatttcccttaaatccaaggaaggtctcaaatgggatatcatgcccctctttttgtaaaggtgtcccgcagaccggacagtcccggtctggcatatcgcatccggacatacctttttttgcatatggttttactgcatctgaatcgaagtctacataatggcatttcgggcaaatgtaatgtgcagacagaggattaacttctgtgattcctgccattgtcgctacgaaagaggaacctaccgaacctcttgaacctaccaggtatccatggtcatttgaatcccacacaagcttctgcgcgatgatatacattacggcaaatccattggatatgatggaattcaactctctttggagtcgttcttctacgatatccggaagatccggtccataaatctcatgcgccttatcataacaaatatttgttaatgtctcatcagactttggaattaccggtggacatttatccggatgtaccggcgatatcttttcgatcatatcagcaatcttattcgtgttcgtaataacaacttccttcgcctttgcctcaccaagatatgcaaactcttctagcatttcttctgtcgttctaaaatacagcggtgcctgattatctgcatcggagaaaccttttcctgccataagaatccggcggtactgctcatcttccggatttaggaaatgtacatcacaggtcgcgacaaccggcttgtgataacgctcgccaagttccacgatcttccggttataattttgcagatcttctactgtttttgcatcatatttatcactctcaagcataaacatgttgttgccgatcggctgaatctcaagataatcatagaaacggaccagttctgctaattcttcttcgctctttccccgaataaccgcctgaaatagctctccggcttcgcaggcagaacctaagatcagtccttctctgtacttttgaatgagactttccggcattttcggacgacggttaaaataatcaagatgcgaggccgataccaaacgattcaaattgacgcggccgatgtcattctttacaaggataattccatgatatgccggtgctttccgaatcagatccggggacatcgctcccatatcatttaactttgcaagcgtatgcacatccttttcttcaagcatttccacaaaacgaagaaagacttctgccgttacccttgcatcatccactgctctgtgatgatgttcctgcttaatgtttaaacgcttacatactgtatttaacttaaacttattcagatccgtaagaagcagtcttgccatctgtaccgtatcaagcaccgtaaaatcggttgtaaatccttgccgctttgcattctcttcaataaagctgacatcaaactctgcattatgcgcaaccaggctgcagccttcgcaaaattccagaaattccggtagaatctcttcaatc

SEQ ID NO: 486 - DNA, 8376 bp, Eubacterium hallii
ggtttgattgtttagacaacgaaatctactaaccgatggaacgccgtgtgcggtgaaagtcgcatgcacggtgtgaagtgggggaaaagcctgagatgatatcaggggcttacctatcactatagaacagtgattttatcctgatgctgaatcaggctgcaggtgacagacagatccttgcaaaacagctgaatatttccccatatcagttgtcttatgtgacgaattccggggaaggtgaaggacttctcttctatggaacaacgatcattccatttaaggataagttcgataagacattgaaattgtatggtctgatgaccacgaagcctggggaaacattgaaacgagataaagaaatgagggatgcaaatgaaggaaatcgataagatccgaatcaagcagtggaatcaggacaatccttacattcagatgaaaaatctggaaaatgtgcagccaggataccgtgttcatacagtcaatgacgatcatcatctgtatgaactgccactggaaacacagaacattattcttgactgggtattctggaacttctatccggcacagaaaatctatccacatcttacaagtgatgatctgaaagaagttttatataaacgtacccagatccatctgtacaataaccagttcaaggaagctatgctgatcaatggattctggccgagagatccgagtgaactgaactgggtatttcatatccaggcaagctctccggcaatcaggacacaggcagatggttatcctggaatcccgatcattggacgccaggaactgaatgagtacagaaagaaaagttgtgccaggaggtgatgacctatagccggaaaagaatttaaaggcaaagataaaaaggtcgcaaagatgaccagagatggtctgacagaagaaaatctccgtgatggtagtgtaaaagatatcagtcacaggagtcgagggcgaccggaaaataaggaagaatttgttcctgaacgagaacgaaaaaaggctgagaatgaagattcaaaatcaggaaaaggaaaacgactgcagatggagaaaattcgtaaatcgtctgctcagcaggaagctgttgaggatacagttgaagtcacactggaagaaaaagtatccggatatcgaaagaaactgcatcgttatgaaaaaatcccggatggtgataacagcctgaacagtcaaaagaaatccattcggaagaagcagctgcaaaaacagatgactaaagaacaggcaaaagccggaagattatcctttgatgatgaaggaaatcagatggtaaaaggtgttggcatgaaaccaggagggacagccggaaaatacattgccacacaagctgttatatctggtatgaaagcagttacttccgaagaggaagaaacagatgaaaatgcaggtgtggaaagtgccagactcgcagagcgtgaaacagaagctgcgttacgtggtctgcgtcatgctcagatccggagcaaacgaacggatgtgaaaacccatcgcagaggttatcgtgaggctaccgtagaaaagaaactgaaatttggttctgtagaaagtatggaaggagccaaacatgcagaaacggtaaagaaagccgaacaaaagagacattcctataaccgcttctttcagaaaaaacgatataaggatgcttaccgggcagccagagctggaaaatccgctggcagtctgggtggagcaacaaccattgccggtgtcgagaacatgacggtaaaagcaaagattgccttgaaagagattgtaaagcgtagtcgtgccatgttcgcaggcatcggtatttttgcgcttctttttcttgtcatagcagtatctctggggagctgcagtgcttctatcgagggtgctggatctgtgattggtattacaacgtatccaagttcagacgaggatatttatgctgccgaaaacagatatgctgctttggaaagtgccttgaatcagcagataaatgagatggaacgaagacatccaaattatgacgagtatcagtacaacattgcagaaattggtcataatccataccatcttatctcgtatcttaccgcaaaatatggggactggacgtactcagatgttgaaaacgaacttcaagctctttttgaagcacaatatcatctgaatacagaaggtcgaacagaaacggtgacagaaaccagaaatgttcgagtcggagaatcattgggacaggtagtgaccagtggatactgtaactgtcgaatctgttgtggagtatggtccggaggtccaactgccagtggtgcatatccaactgcaaaccataccattgctgtagatgcttccaatccgtttgtgccgattggaacaaaggtagtaatgaatggtgtggaatacacagttgaggataccggagcctttgcacgatatggtgtgcagtttgacgtttactatgataaccatgctgccgcttctgctcatggacaccagacctgggaagcctatatcgcagatgacaatggcagtcaggaagtaacggttaccagtacaagcactaagaagattctatatgtgacactgacaaatggaagctttgatgctgtggcaagagccaatctgaatgcagagcagctgatcatctacaatgcattaaatacgacctatggaaacagaaattatctgtgggatgtaaacaatgtgaccagtggatcaagcggtaatggaatgagctatgagattccaccggaagcactgcaggatgaagaatttgcccggatgatccgagaagcggaaaaatatctgggagtaccttatgtatggggtggttactctccgtccggatttgattgctcaggattcgtatcttatgtcattaaccactgtggtaatggctggaactatggacgattgaccgcagatggattaagaggcgtatgtacttatgtatcaccgcaagaagcaaaaccaggagatctgatcttcttccagggaacgtataacacatccggtgcaagccatgtgggtatctatgtcggtaacaatatgatgatccattgtggggatccgatccattactcaaatatcagcacatcctactggcagcaacacttcatgtgctttggaagactgccataaatgggtgattgaagggaggtgaaagtttgaataaaaagattaaaaaatatctggatgagattgccaagacagagaaaaagatcgcggatctgcagcaatatcttaggggtgtccaggctgcattaaagcaggaagaggacaatgagatgatcaggtgcatccgtggtatgaagatggagaatggtcagttgtatgatcttttggatggtatccagaatggaacagttaaatttcaggtaagcagggagtctgacgaagaaggttcaggctcctttgtattcacagaagaaaataaggaggaatatcagaatggtgaaatggaagaaaatgaataagaaaatggcaggactgctgttaggagtcatgatgctttttactgcatcaaccacagcatttgcctatgtggatgaatcagcagaggcatccaaagtagagacaactcagacagatcaatcaacagacaaagaagagaaaaaggatgaggcggcaagtacaaatgaggtgttgccagaagatggaacagaccagggaactgcatttacgacacctggaaatggcgaagttaaggatgacattaccgatgattccacaaaggagtttcttacagttacaacgaagaataataatactttctatatcatgatcgaccgcagtgccacatcccagaatgtctatatgttatcccagattgatgaaaatgatctttcagagtttctggataaagacagcactgctactgtcgtaacaccacagccagatacatcaaaggttgtgctagatgaaacaaataatgaggatgtagacaaggaagctaccgttgatccggagaaaacagcatctaccaaaaccaatatgggtgtaatggcaacaatcctgatcctggctctcggcggtgtagcagcatactactacttcaagatctataagccaaagaaagaggaagacgaggatgatcagccggaagggttggaaacaggtggactggaagaaattccggatgaggaagagtctgaagacgaagattttgaagaaaatgaaaaataaataaacttttttagcggagggggctgtaaaacatgctctctccgtttcgttatatgaaggaggtaatacatcatgtatttagtaattgcagaaaaaccaagtgtatcaagagcaatcgcagaagtgatcggagcacaggaacgagaagacgggtatttaaaaggagctgattgtatggtcagctggtgcttcggacatctggtcgagtatgtttcaccggatgcttacgatgagaaatttagccagtggagatatgaagatctcccgatcatcccgaaagactggaaagttacagtctcagaagataagaaagatcagttctatatcttaaaaagactgctcaacagtccggaaattgaatacgtcgtaaatgcctgtgatgccggacgtgaaggagaattaatcttcaaacatgtctatgacttatccggaagtaaaaagccggtgaaacgattatggatcagttctctggaagattcagcaatccttgatggaatgcaacatctgagatccgcagaggaataccgacatctggccgaagctgctgtatgccgttctcaggctgactggctggtaggaatgaatgcaacaagagcttacaccacaaagtactttaaaaagctgactgttggaagggttcagacaccgacacttgccatgttggtggaacgtgccggacagatcagcaatttccagaaagaaaagtatttcaatgtggaactggattgtgacggaattccggcagtaaagcaaaagatctttgatccggatgaggcggaacagttaagaagcagatgccagggaggtgaagctattgtcactgcagtaaaagaaacagaaaagaaagtaaaagcaccaaagctttatgacctgaccacgctgcagagagaagcaaaccgtatctatggaatgacagccaaacagacactggataccgcccagagcctgtatgaaaagaaactgatcacttatccaagaacggacagccagtatctgaccgaagatatggagcagaccgcaagaaatgtggtccgtcagatttatgagaaatatcaactgacaggtccttttgatcagccggaacagccggatgtgaagaaagtcatgaataacagtaaagtgacagatcaccatgcaatcatcccaacgatggagcttgcatcctgccatctggatgaactgaaatcctgggaagaaaagattctcttcctgatcgcagtccatacggtcatggcaatgagtaaggatcacatttaccaggaaacagagattgaagtggaatgccagggagaaatcttcaaagcaaaaggaaagattgttctgcaggatggatggaaactctttgaaaactgcttcaagaataaggaccgcatggcaatcgtagatccggatcaggaaatgaaagagaggatgccgaaagtaacccagggacagactttctatgctgtagctgcagaaaagacagaacattttacatcgccaccaaaaccatacagcgaagatactctccttgcggcaatggaaacagctggaaataaggaattcgatgaagatacggaaaagaaaggattaggaactccggcaacaagagccggtatcatcgagaaactgatctattcccaatatgccacccgaaaaggaaaacagattcttccaacagatgatggaaaagtccttgttgagatcctgccagacttcctgaaatctgcaagtatgactgcagaatgggaaaaccagttgcttttgatggagcatggagagattgcaccggaacagtttatgactgggatcaaaaacatgctgaccatgatgctgaatggatgcgatgcgatttccgaagaagaaacaagaagatttcagaccagagaaagcattggaacctgtccggtatgtggaagcctggtatatgaaagtaaaaccaacttctattgcagcaaccacgattgtcactttgctctctggaaagacaaccgctatctgcagagcatggaaaaaaacatggataaaaagatggctgcagaacttctgaaaagtggatgtgtgcatgtaaaagacctgtattccagaaagaagaatatgtactttgaggcagatcttcatatggatgcagatgaaaccggaagggtgaatttctctttatcctttccacaaaagaaaccaaaaaacaaaagcaaaaagaaataagaaaacagattagaggagaaaacgaagaatgaattttaatgaatttgtaaatgaagtaaaggacaatatcaaactctttttaccaagggattatgagaatgcagaggtatcaacgatggagtgtcagaaactgaaccgtgcctatacgggactgatggtgagaaaagaaggtgagatgcttaccccgacgatcaatcttaaccggctgtatgaagcatataaagcacagcctggcgtaacaatggaaactgtatgcagaaagattgcagatatagttattgaggcaccgatacaggttgatctgaaagctattttaaactatgaagatgtgaaggacaagctgtttatccgtgtgtcatcagccgaagcaaataaggaagtcctcgaaattgtgccacaccagttaaaggaagatcttgcaattacctatcatgtggcagtaggcaagaatcaggatggattaagttccatgctgattacaaatgaaatgatgaaggaatatggagtgacacaggagcagattcatgaagacgctatgaaaagttcaccgcgtgtcatggtcccagaggtatcaagtataggtgtactgatagatgaaatatatcagaaaaatattctcatgctgacaccagatgaacgtgaaatgctgctagaaacattgcaggagtcaagcgagatgccgacattctttgttgttacaaatacagaaagaattgatggagccggtgtgatcttttatccggaattcatggataacatgggggaacttctgggaaatgatttcttcattttgccatcatccatccatcaaatgctgatcttgccggatgacggtcaagtggatgcggaaatgttaagagatatggtaaaagaagttaatgccactcaggtagcaccagcagaacgccttaccaatgatgtatatcactttgacacaaaggatcacgtctttgaaaaggcagacaggttcacagaacgtcagaaagaaaaagaagcgcaggttgcaaaaacagagaaagttggaaaagaacagccggatcagaaaccgaaaacaaagaaacatgatatggaactttaataaaaaataatcatctcatcaactaataaaaagccctgcggcataagcacaatgtcgtggggcgtttttggaaaggagtattatgacagaacaaaataaaactactactattccactgccggtccatggaaaagatatggacagcattatgcagtcactggaatctggtgtggaagaactttttacaagtaaccgctatcaggaatttcttaaaaccatggcaaagtttcacaattattcctttaacaacacaatgctgattgctatgcagcgaccggatgccacacttgttaccagctacaaaaactggcagtccatgggtagacaggtcatgaaaggtgaaaaaggaattacaatcattgcaccggcaccatataagaaaatgaaggaaaaagaggttctggatgaaaatcagcgaccgatcatgggaaccgatggaaaacctaagactgaacaggtggaagttacggttccgcattttaaagcagttaccgtctttgatattgctcagacatccggggaaccaatccagacactggcaccggaattattgactgcagctgtacaggattttgattctttcatgcaggctattcagaaaatatccccagtgccgattcgattcgatgagatcgatggcaatgccaatggatattatcacaatgcggataaggaaatcgtgatcaaaaaaggactcagtgaaagtcagacattgaagactgccattcatgaaacagcccatgcaaaactgcatgacagggagatcatggaaagtcttggagtagaaaaagaccgactgacaaaagaggttgaggctttatacccatgtttttataatgttgatcttttaaattattttccataaatcctcactttcttgtaaaaaagatgagcattatcagatatgctattatcaggttttcccctcgaatgggaagccggaa

SEQ ID NO: 487 - DNA, 8073 bp, Eubacterium hallii
atcagttgttgctcatccctgccgagataagcccgacgcttttagcatcacatggccataagtctatgaagtattaccctcatagcgtgatgtttgtgcgtcaacgtgtcgcaccaaagatattttccacctcgcggcttgccaaaaggtctttgacgttctgcgtaatggctgtggggataccgccccatttacggaaacgcttccaaatctccacgctgtaagcggcggtctgttcctcttttaagagcaagtgaaactcgtccatatagtagcgggtggatttcttttctgcgcggtttatcgttaccctgttccatgtctggtcttgcacaatgagcatacctaactttttaagctgcttcccaagctgctttatatcaaagcagacaaggcggttagaaagttccacgttggttctgtggttgaatacgttaaggctgccggaaacatacagctccaatgccgccgcaatacgggcagcttccggctccggctgtcttaacagctcgtcgtaaaggtcgcccaagataggcatttttgccgggtcggggtctgcaaggaacggacggtacacatttcttacagccctgtcaatgacggtcttatcgacaggctgcaaaccctccttgccgccaatgacaagctcacacaaggacaggataaaatcagatttcaaggctaacgggttgtcgtcctcagaatagttaagatttatatccatagggtttacatactggggcttgccgtcaatgcccctgcccgtaggggaaagccgtatcacttgcccgttcagacgctgcacaagggaaaaatactcggcttccgggtcgcagatgataatgtcgtcgtcagtaatgaggaaagcatttgtcatttcccttttggcggcgaaactcttaccgcttcccggcgttcccaagataagcccgtttgggtttttgagctgctttctgtcgcagagtatcatattgttagaaagggcgttcaagccatagtacagggcttgccccgtctgaaaaagctcctgcgtgataaagggaatgaaaatagcggtgcttgatgtggtaagcccccgctgtatcgggataaggtttttcccaatcggcacactggataaaagccccgcttcctgctgatagtcaaggcgtgtcaggcggcagttgtatttctgtgcgatacccgccgcagcgaaaatgtcattttccagtttccgcttcgtgtctgccatgtttaccacaaggaatgtaaggagaaacattcgctcgttgcggctctgtaagtcctgcaacaagttctttgcttcgctgccaaaggtggcaaggtcggacgggattatatccatgtcatagccgcttctaaccgcttttttctgttcctcaatcttcatcttgtcaaggtctgtgattttgcgcttaatggtcttgattgcttccgactggtcgatactgcggatatgtaagttgacgattacacctgtttccaagtccagtatgtcagcaagcatacggtcgttgagttccggcgcaaggatttcaaggaagctcgccgcgccgattttacgccccatgcggaaatatctgccctcgccaaaacggaaagaggacggggcgataaaatcctttgtagacagccccgacggggtaagccagtcaaaggaaaaggagaacggctcgccctccgggtggaataccccatgcagcacctttaagcgttcatagccggataaggggcgggaggttacgccaagcaccttgaaattgttaagcacgtcggtttcgatacgggaaagccttgactttgcagccgccttgttatcggcttcaacagtaaaggtaatgtatttgtgcttcacaagcccgttgttgcctttactaagctgatttttcagcatatccgaatactcggtgcggatagagttgaaagcgtcctcctgtgcggggatagagattgctttttctgcctgttcccgctgcgttccttgattgatgaaagaaagctgcacgctcacgctcgcgtcaaagtagttgaggaaatcgcaccagttttcaaaaatggcggtcttatcgtcagcctgtgcaagctgataattgatgtcctcgaacacgacgcactttgaatatctcttttccgtaaccttgcagataccgtccgggtacatggcaaggtagggaatggtctgctgtgcggtgcgggctttgccgtcgcctttagcctttcggatagcttcggcaatctgtttattttcggcgcgggtcagcttacgcctgtttcctgcggcttcccgcgtcttttttgtttgtccttttgacaatcgctgatacctccttttcaagttttcgctgcttttccaagacagcgtataggttttcggttctgtaaggtcgctcctttgggcgggtaaactttgtctgaatgacatttcttaccaccacttcaaggggctgcccatgtttttcatacatggcaagcaggaagcaggggagcatgacgacaatcatcgccatagccgcaaggtttgtccctgcgctgcctttgagcaaaaaaaacagcggcagtccgattaagagagccgccgcaaaacaaacgatttgccgctttgtcagattgaaagcgacttttgttttgactttggaaaggtctttgggtacaggtacatacgccaagaaaaaacctcctttctgcccttagtgggcgttgaatatggattttgccaatgtgccggatttgaatagggaaaaacagaggataaccgtataggcggcaagggaaaataccgcgctgtgcagattgtctgcgattatcatgtcatttaccagtacggcgtaaataccgacacatatcataatgaggaagccttgaaaaccaagagcgaacagcccttttaggtagttgttcccaatctgtccccattctctgttggtcatggtcgcaaatggaataggcgataccgaacagtaaaggtaaatctctatcattctgccgtagaggataacggttatcagtacggacatgattttcatgcaaaggctcacaaggcttgtttcaagcacaagtaaaagcagttcggggatttccatatcttcaagcccctcctgcatggcggcaagggcttcggcaacgtcgatattcgtatcgccgccgataacccccgctgcgccggaaacgatatgctgcgccatatcaaagaccgccattgtgatattgaacgtgttggttacgataaacaccgcgacaaaggctttgaatatccacttaaagaacatgaatgtttctatgtcgtgcatattgttcttttccgttaccatgctgattagctcgtagcataggacataggtaatgacaagccccgcaatcgggacgattacattttcagaaagggtctgtatcatgctgaaaatgtttgcgttccaaccctgcggggtctgtcctacctcgtttgcgatagtcccgactttttcgtttacgtccccgaacatagttgacagattaccgtttatcgctccgataaggatttcctttatccattcgttaatcgcgtcaagtatgctctgcataggcagctacccgcgcttaaccgaacaagccggaaagcagaggtacaaggatagtgccgataagggcaacaccgccgcctgccatgagctgtttcatccccaattaggtgtaaaaactctgctcgatggcgggcggcggcgtacaaaaaatctatatggtgttgttaagagaaccgtcccggcgggacaggtcaggcagtgacctgttccacctccgggatgggtttgagattaaaatgaatttcgatagaaatgtgtcttgttttatcttcgtcaatgcgctcatgcacaacgatttctttgattaagcggttgagggtggctgcgtccagctctgtgatgttggcgtattcctgaatggcttccacccattgttttgcatcattggcaagctggacttcatcggacagccgctttctgccctcggacacttttgttttaagctccgtctgctcggtctgtgtcttttccagcatggtgttgaaattctgctcactgatacgccctgcaatcatatcctcataaagccgcatgaccattttgtccagaacctcaatccgttcctcgtcccttgtaagggagcgttccattgcttcccgctgttcccgctgctcggcttcacaggtattggtcaggcggtcggcaaccgcttccccgtccatcagggcagctctggcacattcccggattttccgcagcacatggctgtaaagggtgtcataatcaatccggtgctgggtgcagtggttctttccaaaggcattgtaggtcttgcaggagtaaatccgctggggatgtttagcgtttgtgtagcgtaccgtcagcgacttcccacactcgccgcattttaacagtccggcaaacaggctgatttcattggtctgccccggacgctggcgggatttcagcttgttctgcacaatgtcaaagctcatgctgtcaatcagcggttcatgctgtccctccaccacaatccagtcctccggcttcttttccccaatcgtgccgattttgaagcggtagtcctttttctgggaagcaatcgccccggtgtagacgggattcatcaaaaggtctttgataacggagaagtcccacatataccgcccgttttctgggtctttcttttcccatttggtgcgggtattgcgaagcccccgttcccggttccaccatgtagggcaggggattttttctttctccagccgtctgcggatatagttcggaccatgaccgttcagggcatatccgaaaatcagccgcacaatcggggcggtttcctcgtcaatgagcagatggtttttgtcctccgggtctttccgatacccaaacggggcaagacacccggtaaactgtcctttctgcgctttcagaagataagaggaatggactttcttggaaatatccttgctgtacatctcgttcaggatattcttgaacggggcaatgtcgttgttatcccgcagggtgtcgatgccgtcattcatggcgatatagcggacaccgtttcttgggaaaaagtcctcaatcaaatgcccggtttgcagataattacgccccagtcggctgaggtctttcgtgatgacaaggttgatctgcctgcgctcaatggctctcaacattctctgtaggtcaggacgctccatgttaagacctgtgaagccatcgtcctgatagactgccacaacctcccatccctgcttttcgcagtatttttccagcatatcacgctggtttgcgatactggcactttcgccttgcaggtcatcgtcctttgacagcctgcaatagaccgccgcacgataacccccggcaagtgccgaaccgattgttctgtattccatttcgttcatcatagccatttacccacacaatccagacggtatctggctcttttgaacctcatcttcattatagcctatatctttctttttagcaagatattcttttgcatttgtctttccgtatttctgggaaatcaggctgacgaacacatcagtggcgtcaagctccccgtcaaatacagtggtcacatgaatctctgttttgttttttgccataggcagttatcctccatacatgaaaatagccagacagagggtgtcggcaacgaagtccggcaacggacttcaaaagaccttgcaaacaatctcaatctggcgatggttactatttatacttttcttttatttttttgttgttttggttgttataagggagaaaagcccggaaataaggggtttttcccggcaaccggctcggcaacgggataacaacagggggtgcaacgggctgtccttttcagaatggaagctccatctgttctgtgacctccacaaaaccgtccatcgttttttcagacgggttgccggagtccgttgccgggttttcacgctcccagcccttttgtctgccatattcggaaaacattcttgggtttgggaagtaccgccagctggaaatgcactggttcataatctcgttgatttcccggatttcccattgcttcggctcgtcaaaagcatggttcaaggcttccttatagagctgcttggagcagaccatgctcccggtgtatttatcaagatacgcctgtatcatcccggctttggtgtcctccggcataaaatcccgctggtgttctttgagataccgctgcatggcggggctgaaagccagcttgaacctgccgcttttataaatctccatcgcttccgcccacatctgcccgatataggctctggaagcggcttcatcctccaaaatgtgaacttccgcctgctccgggtacaccatgaccgggataaagcggcggttgccggaacggtcaaggggcaggaagtcaagggcattggaagtgccgccaaacacgcactgacgggggcggtctgccgggtgggtttcataaggtatcttgtagacctctttctgccggcttaaaaatgacttgatttcctcaatgctcttggcgttggcggttgccatcatttccgacatttcaataatccagtgaccttgcagcttgcggtacacattgtcatcgtccagcttccgcaaatcatcggagaaccactcgtcccggactgccagcagccggaagaaggtggactttccagccccctgaccgcctaccagacagagcatgatttcaaacttgcaccccggctgaaaggctcgtgagattgcacccagcaggaacagcttcaacgcttcataggtgtaatcgtctgcgtcagcccccagaaagtgccgcaggcagaagcggattcgctctgtcccgtcccacacaagggtattgagatagtcccggatgggatggtacttgttttcattcgccacaatcccgatggcgttatcaatctttttctcattggtaagcccgtaggtttcttccagataaagaagcagatacttcatgtccgtatcgttcagggcggtgctttctctgtgaaaaccgatgggctttatgatgtccttgcggtcagtcaggatgttgtatgcgatagcccctgaaagcagagggtcacgttggaatacggtcaggcagttccgtatgctctgacggacaccgcctttctcggtggtttccagccccgccttgatttcctcaacgctctggggcggctgcatggcgttcatagtgttttttagttcttgctgcgtctgcggctgcaagttctgccattcgctgttcaagctgtatcacatcctttccgtagtccgtaatcaaatccgctttttcctctgtttccccgaacagcagcacatccagcagatattccacttgggcttgcttctgtaaggcttccacaaaccggggatgaaaggcttcctccggggagtgcggggcgtagtccgttctccatgccatcagcagatggagataatcggcaagaatacggaagcagcgattctttgcttcctgaaactgttcctccggggatttctgccgggtcttgggcttttttacctttcccggcggtttccagtcctcataggaaagcccgaagtcctgtgccagctgtacggcggcttctttctttcccagcccatacagggcggcggcaaaatcaatcacatccccatccgcaccgcagccgaagcaatggtaacgccgatccagcttcatgcttggggttttatcgttatggaacgggcagcaagccatcccgttccgacctacatggattccataatactccgcagcctgtcttgttgtgacggactgcttcacagcttcgaatacattcaaatctatccctccttgaaaataagaaaagcacctgacattctctaattgaaaatggcaagtgcctgttaaagttccatatcctgttgtctgtgtttctcctgtgccggggcggttctttgtgcttttttctcgtcagtcttatcctgcaagacttctttgatgggctgcttcttgggcggctctttgctttcctctgtgccgggtgtggctttccgtacccagtagcggatgtcccgcagcttcttcaaatcctcctgtacctcg

SEQ ID NO: 488 - DNA, 7947 bp, Eubacterium hallii
gcagagcgtctttatgaagctgtatggaaggagaatttttactatggtgcagagaatacagtaatggtgcatattcgaaatctcagaagaaaggtagaacgggattctaaaaacccgtccattataaagacttcatggggaaagggatattattgtgattaaaaaagtacgggaaaaaacaaagggctggcagattcataaacagttgatcgttcttattcttttaacgggaatggtgagtgttcttttatttgaagtactatggttaaacaagtggaatatttatgagtatgttcgacagattccgggattgcatgatgtatcattggatgaagatttttgggaagatttacgagcagaagcaacaaagtatgatataccttcttcggaagacgataaggcagggattaagaagattcagccgtttcttgaacaaggagataaatataccggaatttatatttatgcgttaaaagaaggaaattacataaccggaagatttcctaaagccttggagaatgcagcatttagtacattttttgatatgggatatcagcttaccggaggcgaaggggaggaaacatatgagtttcctatgaagttcaagaatggatatgcgacagtaatggtatggttttatcacagagtgcgctttatttatccatattgtattttttcattaactgtcagtattggtttattttttaccgtcattttatttttcataaaaaagaaaatgaatctggttgaggaactaaaagatgagattctcagaatggcagcaggtaatctcagggacagtgtaccgaatatggggcaggatgagattggaatcattgcggaagaactggataatttaagagcgccattgcaggatacattagttcgcgagaaagaaagccgcagagcgaatcaggatctgattacggcgatgtcacatgacttaaggacaccattgaccattttaaatggatatttagaagtacttcgcttgaatagaaatccggaaatgcatgaggaatatttaaagagatgcctgcaaaagaccagtgatattcgagaaatgacagatagaatgtttgaatatgcactggtatttgaagagggagaagagccaaaagtaaaggaaattccaataaagtttttcagggactgtatcaatgaacatagtgattttatacgtctggcaggatttcagacagagatggaatatacttatgtcgaaagatggattacgggagataaagggatgataaaacggattctcagtaatcttttttccaatattttaaagtatggagataagtcttccccggtatttataaagggaagttttacaaagcaatcatacattcttgaaatatctaacactgtaaaacaacaaaataccggggtggaaagcaatcatattggattaatgagtgtagaaaaaatgatgcaccaactcggaggagaaagtacgttctctgaaaaaaaatggctcattctctgtagaattaaaatttagtttagttcattaagaaaatggatggagcgaaaagataatcgattcctttcggagccaacaagcagaaaataaaaatttcagaccatagtataatgtaatgtgagagcaagtaaaaatgccgggaaggcattttctacgcagtgatatctttacatttgctatggtctgaaatttttattttcgttggtttcttctaatgaatcaaataatcatccagtcttttgaaggcctcttttattctgctaagtggcagggcaagattaaatgttttgcttgaagtaattgaagccttgaaagtgatatagtcttttctattataagaatgttataaaatattttcaatgtaattttatgaagttaaaaatgtactaaataaagctgataattttcttgaaaatacagtactacagacattgcaaacagaagggggagtgtgataaaatgggtgtgaatttttacaaggaggaagatttatggaaggattaagaaaaagtgaaaagtttatgtcagaatataagctaagtatttttctgacattagcgatgctggcaatgttgttttttacagcaggaatgaaaacggatgccgcggaagttccaaatggccttgttgtaaataatggggtaatttcttattatgaaaatgagacagttgttaaaaacacatggaaaacagtagatggtaagaagtattatttccagagtaatggaaaggctgctgttggtagtgtaaaagtaaagaaagcgtattatgtctttaatgaagctggtattttacagacaggtaagaaacgtcttgtgactgtgaagaacaaacagtattacgcagcaaagaatggaaaggctctttctggaatttactatataaagaataagttctatgcatttaataagaatggggcctgtaaccagaaaaagacaaagaagcttaaagcggctgcaaagtataataagaactttaaaaagcttaaaaagcttttaggcaagccaaagaagacgaagtatgagtcatattcctgttatggaccgggaaatgacggatacattaagtatgctaattttactgtatatgtatacaagtacaaaggtaaagtattgtatatgggtgcagagtaaagaataaatcattatatctaacaaaggagagaattgaaatgaaaagtatcaagaaatatgttgggatttttctgctggcattatgtctgattggaacaatgcaggcagtaccatgtaaggctgcaagtctgaattcaaatgtgaatggaatcgttaaaagtcaggttcttcctgaagacacgaaggaagtaaagttacagaagttattccagtatacagagaagacttatggttacaaacgacagattggtttcaagaataaaaaaggctggacaaaaacatatgcacagaagatgatcaagagcaaaaaaggaagctgttatcattttgctgctgtttatggttatctcgctaaaaaagcaacaggatataaagttcgtgttgctgtcggtcagacaaaaggatttagcggttcatggcagccacatgcatggacagaagttaaggttaaaggtaaatggtatatctttgatactaatatggataagtttaaagcgaactctactttaaaatactataacatgttaaagacaagtaaagctgcaaagaaagtttataaaaacaaaggagtaaagtatgttaacatcaagtaattttacctcctgtatagattttgtgaagaagaattttcgtgttgtaaagatgttcctttttgctgctgttttagtatttgcattttctgtaaatggacatgcagaagaagctggttctcagaatcctgcggaaggaacaacaatacaggaagagacaacaacagagcaggaagtaaaacctgtaattaagaatggtctggtagaagaaaacggtaaatactatttttataaagatggaaagaaactgaaaaaggtctggaagactgtaaatggaaagaaatactattttaaaaagaatggacaggctgcaacaggttcttataaagtgaaaaagaaatactatatttttaatgaaaagggcgtatttaagaagtataagtctgaacagccagtaagtgtaggaaaaagagtatattttgtttctaaaaaaggtatggcagcaccaggatggcatgtatatgagaataaattgtattatgcgaagaagtccggtgtatgtgcaaagtctcagacagtagatggcattacatttactaagaggtcttatgcagcgaataatacaaatactaagtcaaagatcaaggcaagaaagattgttgaaagaattacaacaagtaaaatgagcagagcgcagaagagacgtgcatgctggaattacatggtaagacgcggacgttttcattatgcattaaagtatcctaacttatctaaaaagggatggcagagagcgactgctttaaatatgctttctacaaagagtggaaactgctatagtttcgcttgtggatttgcagcattaacaaaagaaattggtgacagaccagttgtaatctgcggaagagtaagcggaagaagagatcatgccagtgacggtatgacaagacacagctgggtacagattggcggaagaaattatgatccagaaggacagtttgccggatgggcaagaggaatctatggttctgcaggatatcgtgttcgtcatagcattcagaggaaagtggtgttctagggaaaatggtatttagttcttttgaatttttatgtatatttctccctgtactctgcatagtatatgcaatactgccatctatgcgatggaaaaacgggctgcttattataggcagcctcctcttctatgcatacggagaaccggtatacgtattattaatgataggaagttccctggtacattatctgcttgctatgggaatcagtaaatctgcttctgcaaagaatcctctgctggcgctggatgttattttgagtcttgttgttcttggactctttaaatatacaggaatgatcgttacaacgattaatcagattgcacattctaacataccagtaccagctattgttatgcctatcggcatatctttttttacgttccagtctatgtcttatgtaattgatgtatatcgtgaacgtgttgaagtgcagactaacttttttaaagtattgttgtacatatctttcttcccacagttaattgcgggaccgattgtaaaatatagagatatcagcaaagagattgatgaaagacatgcggatgcacaacaggtaatgcagggacttcagagatttattataggtctttcaaagaaagttcttatttctaatacagttggacaggtagccgatcatatttttgcagcgcaggcatcatccattaatggtgttacagcatggcttgcggcaatcagctaccttttacagatttattatgatttcagtggttacagtgatatggccattggtcttggacaggtattcggttttcattttcgtgagaacttcgaccatccatacgatgcaacatgtattcgtgacttctggagaaagtggcatatttccttatcttcctggttcaaggattatgtatatattccattaggaggtaatcgaaaagggaaggttcgtacagcaataaataaattgatcgtattctttcttaccggtttatggcatggtgcaaactggacatttgttgtatggggattattccatggctgctttttgatgcttgaagagtttgttccaaagctgcagaaacttcctcgtgtagtggcacatatttatagcttagtcgtagttacggttggttttgttattttccgagcagataccttagcgcagggatggatgtttattcggaaaatgttctccgacttttctatgtctgcggcaggaaacagccttgcaatgcagcagatgacaccatggtttatctttattcttgtcattgctgttctttgcgctgcaccggtaaattcacttgtaaaaggaatcagaagcaagatgacggaaggaagtaaaggattggctgtttgcggaacaataaaaagtgtatttacactggtattacttttatggtgcatgatccgactttccggaaatgcatataatccatttatttattttagattttagaggaaggaatgtgatgaaaatgaaatataaattatatatcgttatatttatggtaatgtgcattcttccttttgccggaatggcagttgcaaaaacagagacaacaacagagaatagaacaatggctgctttcccttcttttatggaagaaggaaagtggaatgtaaattacctgcaggacttaggagcatactttgaagatcattatgcgtttagaaatcttctggtttccgtagattcgcagatacaggcaaagttatttaaaacatcaaatatggatactgtcattgtgggaaagaatgactggctgtattacacagcttctcttgacaactatcttggacagaacctgatgtctgatcaggaagtttataatgcagcatataatctgtctattgtgcaggaatatgtccagagcagaggcgcaaagtttttagtagcagtacctccaaataagaattcgttatatggggaaaatatgccatattatgaccagtctaaggtaagtagtgagagaaattatacgaatatcataaaggctcttaaatcgaataaagtagcatatacagatttgtatcagcttttttccaataagaaagaaactttgtatttgaagagagattctcactggaatgaaaaaggttctttgcttgcatataatgcgctgctcacagatttaaataaagagcatgaattgtatgagacggtgccggtacttcgaacaaagacagaaatcggagatctgaataagatgatttatccgatgtggagccagccggaatggaattatgattatcaatataagaagaattatgcatacacatctgatacaaaaagcgtggaagatgcatatatcatgacaacaaacaaaaaggcccagggttctcttttaatgtttcgtgattcctttggaaatacattacttccatggatggcacagtcctatgagaaagctgtattttcaaaagagatgccatatccgttagaaaaatatatgcaggaatccaaggcagatactgttattatagaaaaggtagaaagaaatttaaaagactttataacagatccaccaatgcttactccatcagagacaaagttatccggtgaagcaaaacaggtagagacaaagaccacagttcatgtgggtgtcagtgaagcggatactgcttatacagaagtttccggaaaacttgattctaaatatgttacaccaggaatgaaagtatatatagcggttggagaagattctgatcagcatatttatcaggcgtatctggtgaatgataattctttagatactacaactacacagtatcgtctgtatcttccacaggagacggtagatacaaagacgaaagttcaggtttatgtagagtcagagcagggtctttatcttgtgggacagagcttgaagggagaatagtatgagagtaaataaatatataattgcaattgcagcaggtatattttccctgagtatgttgtccggatgtcagtcaaataaaaaggcagatatgaatgtaagtatccaggatggtcaggtacagacaaaacttgctgtagcgaaaggttcctctgtatctgatattcttaaagaagcggagattactctgaataagaaggatcaaattaccccatcccttactacgaaactagatagcggagaagaaaaaatagagatagctcgttatgaaaagttaaaagtatcggatgataataaagaacaggaagtagaaatcctcggcggcaaggtaaaagatgtccttgaacaagcagggattactcttggaaaacatgatatcgtaaatcatgatttggaggcaagctgtacggatgacatggatatccaggtaatccgccgggtagaagtttctctgcgggcagatggcaagacaaaaaagacagtcactcaggcaaaaacagtcaaagaatttcttaacgaaaataatattgctctttccaaaaaggatcgtatacgccctgcattaaataaacctttaaaagaaggaacaaaagttgtagtagaacgagttgaaacaagaaaagaaaagaagacagaagagattgcatttagcgtggaaacacagaaatcttcttctatgtatgtaggttcaagtaaagtaacaagagagggcgtgaatggctctaaagaagttacatatcagattacttatgtagatggcaaagaagagagccgtaaaaaagtaaaagaaaaggtaatcaaagagcctgtttctaagattgttacagaaggcacaaaagaaaaaccacagcaatcttcacagaaatcttctggttc

SEQ ID NO: 489 - DNA, 7610 bp, Eubacterium hallii
aaatttgcttttttcatttcttatgccacctacactttctcctgtacctgtttgccaagaagtcccgtaggctttactaaaagtacgatgatcaatacggcaaatacgattgcatcagataactgtgaagaaatatatgctcttcccagaatctcaattactcccagtaaaataccaccaatcaacgctcccggaatcgaaccgataccaccaaataccgccgcagtgaatgctttgataccaggcatcgctccggtatacggagaaagagtcggatatgcggaacataacaatacaccagcgattgcagcaagaccggaaccgattgcaaatgtaagcgaaattgtcttatttacatttacacccataagctgtgccgcatctttatcttcagatactgcaagcattgcctgacctgacttcgactttttaataaaaatcatcaatgctgccataataacaatacaactgattactgttgcgattgttacaccggaaattgtaagatctcctccagccagcttaattgatggaatatgtacaacagacgtaaacgactttgtgtccgctccgaataaaatcagcgctaagttctgtaaaaagtaactgacaccaattgcagtaatcaataccgcaagtggagatgcttttcgaagtggtttatacgcaatcttttcaattactacaccaagaagggtgcatcctataaccgcagcaataatgcttactgtagaattcagatggaagctgcccatcaaaacaaaaacaatataacagccaatcatgataacatcgccatgtgcgaagttcagcatcttagcgataccgtataccatagtatagccaagggcaataattgcgtaaatacttcccaagctgataccatttatcaaatatgatataaaactcatatgttttcctccgtgccgtccttacggcttttctaaaaaacgaaaaacttctctaaaccaaaaaaggagctacccgcaggtaaccccttccctgggctatattatttaatccaaatcacttaagaattacattgccttgtaagcaccgtttttaataataacagccttaggagacttagttacttctccactctcattccatgtaagaccgtcttttccacctgtgagaccctgcatcttaatcttagtcatcgcaccttttaatgcatcgcacatatcagaagcactcatatctgtagtcgctttagattcctcgattgctgcctttaatgcgtaaacagcatcgtaagagtctgctgcgaattggttcggagtatctttatatttttctttgtaagtctttacaaagttctgaactgccttatctttcgcatctgctgcgaatggtgttaagagcataacatcttctgctaacttcgtatcaaagttctctacagtaaggataccatccattccgtctacaccgaagaatttcggtttatatcccatagtatctgcctgctttaagataatagaagcttcctgatagtaaataggtaagaagagtaaatcagctcctgcatcctttgctttctgaagctgtgttccaaagtctgtcttagaatctgctgtaaatgctgctttagaaacaatctgcagtcctttatccttagcttctgcttcaaacttctcttcgatacctgaagaatatacatcagaactatcatagataataccaatcttcttagcaagcttgttctctgcaatatactgagcagatgcaataccctggttagggtctgtaaaacatacctggaatatattaccgtttccactggagagtacatctggtgcagatgcagatggagtaatctggaacatattatcagaagctgtcttacctgctactgcgatacatggggcagttgttgttgttcctactaacatctgcatgccccagtcttttaatgtattataggcattcactgacttctccgcatcattctgatcatcttcaaaacgatactcaatctgctttccgttaataccacctgccgcattaatctcatctactgcaatctgtgctccgttctttacggctgttccgtaaatggcagttgcaccggtagtcggtccaataccgccaatataatatttatccgcatcctttttcgatgaagatcctgaattacttccacatcctgttaatgcagttactgccatcgcagcgactaacattatacttataaactttttcattatttcttcctcctttataatatataatgaaaaatatatctttaatgtatcaactcaatgtcaagtattctgattccactaccactttgtcaataccttagatatttttatggactttatcttactacactaaagcaataaaatcaagtttttttgaaggattaaaaaaattttttgcatatttttttgtttttgacttcatttttcactttttatctcatagaaagctccctgcttctccacgatccaaactcatgtaatacgacacgcttcctatagaaaacatacaaatccgctctatgataccttaatattttgaatgttatttataaaataaaacaactccgctcgcaaaaacagataggaacaacctgctttatgagcggagtttgaaatagttacttttttgacggaaaatcacccttaccagtcaaacagtttaacacattacattaatgagagaggatttccgttccatcttccgtcaccaaaattgtgtattcccactgtgcggaaggcttaccatcttctgtgcggattgtccagccgtcatcttcgtcttcccatacgtctggttttcccatatttaccattggttcaatcgtaaatgtcattcccggcacaaaaagaatgccttcatctggttcaccgatatgattgacccatggttcttcatggaactgtacaccacatccatgtcctccgatttctcttacaacgctgtatccattctctacagcatgtttattacaaacataccccatatctcccatcgttccccaaggctttgttgcctcaagcgcaagatcgacacattcttttgttacacgaacaagctttttcttttcttctgaaacctcaccgatgcagaacattcttgatgcatcaccgaaatatccattataaattgtcgtacagtctacattcagaatctgtccactttttaaaatctggtcatcacttgggataccatggcacaccacatcatcaatagatatacagacactttttggatatccctgataaccaagacatgccggaattccaccgatttctcttgtgtattcttcaataagacggtttaactctcccgtacttactccctcctttacataaggagtaataaagtcaagcaccatcgtattcttcttacctgcttcgcgtattccttctatctgttccggtgttttgatcatagaatgatctggcacttcatatcctctgttccagtaatctttgatacgattatcaaaggacatatgacatgccttatattttcttccactgccacaccagcatttatcatttcttcctatcttcattttgatccttctttctgtatcattcctctaatttattgagcgaccgcagctattttttcttccactgtcacatatcgtatattaagctacttactcttattttgcaatatttatttcattttacctatctatttgggataaatgcagatttttgcatttttatctactgttttcataatctttttcatatacttttctttcactgcaacacaacctcccgtatacggattgcttcctgtacaatgtaagaaaatagctgccccttttttatagatgcattttttattataatcaatcgccaatgcataattataatgcggtctgtaacggatgagatgttcccccgcgcggcttgcctttacttttcgaatatctatcatctgattataatactttctgtccgcactccagtacagataagaatttaactttatgtattttatcttacttcccggattacttttgattccaaacgcttttgtgaaaccataggtaccagtcggtgttttcttatcaccttcacgctttttatttattccgttctttccaacataaccggcacaggcaaatacttttttaaactttccgtttgcttttttatacaaaataatatctgccttactgtttcctttgtatttcacaaaaataagctgttttaccttctcactcttctcgtatttttgaataagtctggtccatctgttcttttttactgcagcttttttatctgacatatcctccttctggctttttatcgtttccgcctgtacagatacagtattccctgacatagtaactatacttatcacaaaaataattgttaaaaaaatcgccaatccattcaagcaaagagttcctattttcgtagttcctttcataatatgtgtttcctttcttttttattcaaccttaacccaccatacatttaagcgaattgatttccttaaaaggataacacaaagcttgtaaaagataaagtttgcactttcatctataacaaaacagaccctgaagatctgattgtcacaaatctacaaggtctatttttgtttattttttaattagacgcagatcatctttgtcctttataagcattatctgcttatttcttaataagcagtgactttcctgtcatttcttttggctgttccattcccatcatctcgattaaggttggagcaatatctgctaagcatccgccttctcttaatgtataagccggatcatagtttacaaggataaacggaactgggtttgttgtatgtgctgtgtatggttctcctgtttcatagtcaattaactgttcgcagtttccatgatctgcacagataaacatctgtccatctacttcttttaatgctgccactgcatttccaacgcaggtatctactgtctcaactgccttaattgctgcttcctgtacgccagtatgtcctaccatgtcagggtttgcaaagttgatgataatcacatcgtatttatcagatttgattgcttctacaagtttttctccaacttctggtgcgctcatctccggctgtaaatcataagttgctactgctggagacttaacaaggattctatcctcattcttatttggaacttctacacctccattgaagaagaatgttacatgcgcgtatttttctgtctctgcaagacgaagctgtgtcaaaccgtttgctgcaaggaattctccgaaggtgtttgtaatttcttctttatggaatgcgatgatctttccagggattgtctcatcatattctgtaaaacaaacataagttaatgggaatactccatttcttctttcaaatcctgtaaattcagggtcacacatggcacgagtgatttctcttgcacggtctggacggaagttgaagaagataacggaatcatttgcttttactgtgcctactggctgtccatctttcttgattactgtagggataacgaactcatctgtcttatcattatcataagaagcctgaattgcctctactgcatctgctgcttcattaccttcaccgtaaactaaagcagcgtaagctttttctacacgatcccagcggttatctctgtccattgcatagtaacgtccttcaatggatgcaatctgtcctacaccaatctctttgatcttagcttctaattcttcgatgaattctttaccagatgttggggatgtgtcacgaccatcaaggaaacaatgtacacatacgtctgtaagtccctgtctctttgcaagctctaataaagcataaagatgtgtgttgtggctgtgtactccaccatcagataataaaccatataaatgaagtgtggaattattctttttacagttttctactgcttctaaaaacgctttattatcaaagaaatcgccatcctgaattgcttttgtaattcttgtaagctcctgatatacgatacgtcctgcacccatgttaagatgtccaacttctgagttacccatctgtccgtccggaagaccaacagcaagaccgctggcatttccttttacaaatggacattcttccattaacttatcgatatttggagtgtttgcctcatatacagcattggcttcatgtctgtcatttaaaccaaagccgtccataattaataatactgtaggttttttactcattttataatctcccgtttaaagtttagttgacccgcggagaaaagtccgcgggttactgttaacattcttattactctgctttaaaatgcaaagcttattatttgttatagtttacaatctgaccaaaatcagcttttaaggaagctccaccaacaagacctccatcaatatctgcctgtgcaaataggtctggagctgtcttagcgtttacacttccgccatactgaatacggattgctgcagcagttgcatcatcatagatttctgcgatacatttacgaatctctgcacaaacttcctgagcctgttctgttgtagcagtctttcctgttccgattgcccagattggctcataagcgattactgctgtcttagcctggtctgctgttacatttaagaaaccaactttaacctgctgacggataaagtccattgtaacaccctgttctctctgctctaaagtttctccacagcacatgattggtgtaataccatgttcgaaagcttttaacatctttttgttaactgtttcgtttgtctctgcgaagtattctcttctttcagaatgtccgagaacaacgtattttactccggcatctactaacatagcaggagaaatctcaccagtgtaagcaccgctttcttcatagtacatattctctgcaccgattgcaatgttagaaccttttgcagcttccatagctgggataatgtcgattgctggtacgcagaatactacgtcaacatcttcattcgcacaaagtggttttaacatatttactaattcaactgcctcactaggagttttattcattttccagttacctgctacgattttcttacgcataacaaattcccctttattatatatttatgatgttagggtcagaaggtattctgcccctaactgatgtcacgaattactccgtagctaacgctactcccgtaattctaaaattatttatcgtttgctgctgcaacacctggtaattccttaccttctaagaactcaagagaagctccgccacctgtagaaatatggctcatcttgtcaccatatccaagctggttaactgctgctgcagaatctccaccaccgatgattgttgtagcatctgtttcagcaagtgctgctgcaactgcctttgtacctgctgcaaggattgggttttcaaatacacccataggtccgttccatacaactgtcttagctgtctttacagcatctgcgtataattcgattgtcttaggtccgatgtcgcaggcttctttatctgctgccataacatctgcatcgtatacatatgttgggatttcagcatcgattgggttaggaaaagcatccaccattacggaatcaactggaagaagtaacttcttaccaagcttttctgctttttccatcatttctttacagtaatcaatctttgt

SEQ ID NO: 490 - DNA, 7487 bp, Eubacterium hallii
gaatatcgaacggatgtataaaaatggaatagccaagatcgaaccatcgaaaacaaacagtctgtatgacagatgctatgtttttgaggagatcaattatatcaacaaggatgaaagtgaaaaagatattttcctgaaccagttcatgtcctggttaaagtcgatgagcgttgattttaagattactatagcaaacgaatttcagagtattgacgaatttttagaaaagatacggggaaagcagaacagcaaggcttacccgcagattgataaagggataaaagaatggacaagggaaaaactggagaattctaatccgaacgtaacgacactccgttatcttaccgtttcctgccgggcaaattctctggaagaagcgactatcctgctcaatgcgctggatacaacgatacagcagatgtttgcaaagtggcgtggaaagatacttctcttaaacggtgaagaacggttaaaatgcctgcacgcattactacgtccgggcaaaaaagacgaagaacagtatatctatcttgatgagacaggaaagcatgactggaaaaatgatgtgatgccacagacaatcaagcagtattccaattttatgatttttgacaagacacagtatgtatcggtcttatttgggtggaaatacagcagggcattaaagccggatgagctgatgcggagtttttcctatgtggattttccatcgtttatcacgttagatttttcccctgtccctgccgatgttatcaatgaaaaactggtggctgcagcgatgaacaatgaaaaatccatcagtgaggaagaagaagcaaaaaggaaaaagaatatcattgtatcaggaccttcttacgcaaagcagagaaaaaaagatgagatagaaggatacatggatttagtaaatgacaatgatgagacagggtttttcctgaatttcctgttcgtggcaacagcagcagatgaaacaaccctcgcacaacgagtcgagcagttaaaagagacaggcaaggcacagggagtagtcatcagtacggcggattacacacagttaaaagcattaaatacggcactgccgtttgccggacggcaggtcgattatatgcgtttcttcctatcttcctcgatggttgcgatgcagccatactttgcccaggacatcttagaccctggcgggtatttttatggattaaacctgacaacaaaacgtctgatatttggcaatagaaaattactgatgaatccccacgcaatcattgtcgggtatacaggttcaggtaaatccgtgttgattaaggcaacagagatatttcagacacttatctctacatcagatgacattttaatcctagaccctcagaatgaatttaaggaaattgtagaaaaatacggcggttcctattttgatctgactccaaaatcaaagatatatatcaatggttttgaagtatctgatgcagtattttatgcggacaaagacacgaaagaaaaatttatcgctacacagacaaagtacgccaaaagtcttgttgcggccatcatgacaaatatcctgttcacgcaggaacacgctacggtagtcagcagggcgacaagaaagatgtttgataaaatctttgcacagaaaaaattaaagaagcaggcaaccttacggatgttgagggaagagataaaactggaattggaaaatgcaaaagatgattatgatagatctatcataaagccaatctataactctcttgaagaatacacggacggaagttgtgatatgctcgcttatccatccacagtacgtttagataaccgtatgattggattcggattaaaaaacgtaccgccagataactgggagccagttatggtaacggttatgcattatacctctacacgaatggaatacaatcaagaggcacagagggcaacccactttatcgtggacgaaacgcaggttgtcagccgaaaaggtacttctgcagaacagctcaatacggctgttgccacatttagaaagtatggcggcatctgtacgatggcaatgcagaatatcactgctgccttagaaaacaagatgttaaaagaattgttcagtaactgtaactataaatgctttttagaccagggaggagccgatgcgaatgcccttgcccagatccaggaattatcccagacagaatttaatgcattaagttctgaagaagtaggaagaggagtgatggtctggggaaaaaaggttgtcctctttgatgcaaagatctcaaaagaaaatgaactgtatccgcttatcaataccaattttcacgagaaggcaaaagaagcagaaaagaaaaaacagaaacagagacaggagcagcaggagagcaatgaccgtatcgaggagattatcctgcaaatggcagaacttgcccctgttactgtccgtgaccttttatccgtattggaaatcacgcaggaagaagccgaaaaacaattaagttttctgtgccagcaagggtatcttataaaatcggaagaagcaggcaatatccgttatcagaaagcaggctgatgcttatggcagtaaaaaaagcaaaagaagcgagttttaaaaaaatggacagtgcgtttgctacttcccagagtgctatccagaaagtgaagaacaccgaccctcttaatggaaatgaggaacaggaacagggaaacgaaaatgtcagcatagaccctgcccattatctttccaaaaaagaaaaaaaagaatggaaaaggctgtcttatactgcaaagcagcgttatatcaggcaggcagaacggcagttaaaacggcagaaaaaacggaacgggattgcaagaacagaacagagttccgttcaggaaaaagaaaaacaggcagcaaaaatcttttcaaaagaaagaaaatacagatcaaatacatggaaagaacctgttgataaaaaagagatcggtagccatggaggaaatggagaaatcgcatcgaagtcaagggacagccgggcggctatccgttcccagagtaccgttgccgggggagaaaaggcagcagatattgcttctccttctgtttcagcagaaacagcaaaagctgcagggaatgctgcaacaaaaacagcagaaacagcagccgtatctacgggtgctgggctggctgcactgatcgcaaaaaaaacggcagaaaatttcaaagaaatgctgcagcagaaaaatacagcaatcgaaagccagaggataaagacgcagacgaagttgtcccagctcatcgaagaaaataaaacaggtgcaggaagcactagcgtggcagccgcagctatgcttgcctctgttgtagttacagtgatgtattttgcggtacagattgccgtgacgatcttttttgttttgttgatcctgttaataccgatcattgtgatcgtatctttccttggaatcatcatcacgttgctatcaggttttgcagccgcagtagataatacagattatgcatcgggttccggggcaagtattgttgcggttgctgtacaggaaataggttatcacgaagggtcaggcaaccatacaaagtatggagtgtatacaggcacggacggaatgtcctggtgccatgcgtttgtttcgtggtgtgcaaatgaatgtggttttatcgagagcaatatcataccaaagacagccgcctgtgagacaggacggcaatggtttatccataagcagcagtataaaaaggctggaagttataccccacaggcaggagatattatctattttgataaaggcggggtgggagaatcccatcacgttggtatcgttgaatatgtcgaaaatggaatcgtacatacaatagagggcaacaaaaatagtcaggtcatgcgtggacattatgaacttacttataaaggcatcatgggatacggtactccggattatccagacgaaggactcacttcctcgacagcatcagagatcttatcaaaagcacaggagcttggtaaaatgatggtggaggaaaaatgggtgtattccaatactgacctgaaaggttcacttgcggcagcagaacagtctgctaagaggacaaactgtgcccacggtgtctgtcttgtgcttcaggaaattggtctgctgaaaaaaggacagatatttttcggaaacaagtctggagagttaagctgcaatggaaccgtaaggaaacagattgaaaaaggatttgacatcataaagactggcgggaaaaaatcaaaagacctcgacttaaagccgggggatatttgccttttcaaagggcatacgaacatctatgccggaaaagatgagaacggtaaaacatactggtatgattttggacgtgaccagacaaaagacaaaaagccgggaagtaaaggagaaattaactgggcggtcatcacagtgatcctccgggtaaaagaccaagacggatatggttcaggaaaaacaatcaatatcccatcaccgtatggagacagtttcacttacatgggctggtccctcatcaccgcaacaggcagtaaccagtacaagttgcgtgtgaaaacaggtgagcattatgatgcgaacggtttcggaaagataggggacagatatgtgatagcctgcactccaaccttcggaaaaatcggagatgagatagattttgttctggcaaatggcagagtcatacatggtgttatgggcgatgaaaaaaatatgtctgatgcaggctgcaacaaatggggacatgataatggacacagtgttgttgagtttgttgtaaataaatctatgtggtatcacacaggaaaaaccgtcacgaaatttcatccagaatgggcaaaaagccgggttcttaaagcaattaatcttggaaaaaatcatttgaaataataattaaaatgtgccgaaattcggtacaggaaaggagcaggatgaagaaaaaaatagtgatatttctactggctgtctttctggtttttgctttacttgtttccgctttatgttttttcgctccccaaaaaaatcaaaacagcagggaaaatacaacggaacaacaaaagacagaagatgctgcagaacagacggaaaaagaaaaaagggaacaatatcatttcacaaatctggaatatatctattatataaattctgagaatgaaacagattttgaagaacaggcagcagagtatgttgaaaaaaattataaaaacgtgcaatggatcaatgcccttgcaaagtttgatgatgatgtatcaagcaatacagggacagcgacattttatctacaactagatgatgaagataattcggttgttcttatttcctatgataagaaaaaagaaattttttcatttgttccatataaaaagcagattgaaaatattgaagactatggaggaatgccacaggaaaaaaatacaatgcaggatgatgaagaagagtataacgagattggtacagagccgatccatctttgtgagccacagattactgaccaggataattcattagaagcagtagccaatgaaaatgaactgtcgcaggaattattaaaatttttagagaaggaaggggaagaacgaagaaatttttatgttacctctgttgaaaatacaggaggaaaaaattttaaagccgtactggatttcagcacaaaaagaagcgatggaaaaaatatcagtattacttttgaaaatggaatttatacatttgcgtttaaataagtgtgattaaaaaagagatactgggtgataagatatggcaggtctgcaaaaagaaaataaagttttatttgcagtcctgtcatatgtgtgttaattgggagtgattgtctgaaaggggtattaggggctttcccctaacaaggtagtattttgtacacacaaaatgcgtatcttgcaataagcctgtcggcttattcgtaccatttttggtatgaataccagaattggtatatggataataccaaaaatggtacatataaatcataagatcgcttatagataacataaaaaattatggaggaataaatggcaaggcagaaacatttccgtcttccagacgatgttctggagatgataaataacagagataaagaaatatatcctacagaaaatgtatatatcacagaatctgtacggaacttttttaaaaaagaagaaacagaaaatgtgatggatgaattagaggatatacaggataaattgaatcgaatcgaaaaaaagcttgaggaagatgcaggtaaaaaatatagttctttttcaagtgatgcagagaaaaaagaactttatggaaaaccagatttcctaaaatactaacatagattctaagggatggataggatggattggataaagcaaattatagaatgtaaaaaaggaaattgggagtcacccggttctctggggcaaaagattaaaaaaatccgaatgctgcataggtatacacaaaaagaattaggtgtgatgtgcggcttttctctttcttccgcagatgtaaggattgcacagtatgaaaaaaataaaaaaattccaagagaaaaaatcttgaaggctatgtgtaatgctttaggagttggtgaaggtgctttggttcatgcggatatgctttcctatcaggaaatgttttacgcattatttgatatggaagattttcatggattgcacccggttaagaaagaggacggatactatttaagatttggcagcgatagtatcatcaatgattttcttgaagaatggtataagatgtatcaaaaatatccaagaccaagaggagatgatgaggaagaaaaatatacactctgccgttatgaatatccaaatgagatcgcagtggtatcgcagtatgaattattaaaaaggaaagcactgcaggcagagatagaaaatttacaactcaaaataaatgaccttgagaatgaaaataaaggagattgatgagatggattggaagaaacagattgaaaaattggaggacgaacttcaaaaattaacggaaagggaaaataagattgcggaaagaaaaaaagaagtcgaagaaaagctgagaaaagcaaaagagcagaaagagaatgaagagaataaaatgctcgcagagattgtcaccgggcgattgggagaaatggatgctaaaaaaatggatgatctaaaagtaattcttgatatgtatatgtctgatcaggacgaggaaagagcaacagaaaaagaaagataggaaggtgaggaaagataagaaaaaggagaattgacatccggctgagcgaaaaagaatatcagttacttctatctaaggctggaaatgaccttgagacaaaaaccaaaaagggagacaaagcaaacacttctgcatatatacggaagtgtatttttttgcaggaagatcgtcctgtccgattggaaaaagagttaaagaatctttcctaccaagtgcgtaaaataggagtcaatatcaatcaggtcgttgcaaaaattaatgctggttatggcaatcagattgatatttataatctt

SEQ ID NO: 491 - DNA, 7386 bp, Eubacterium hallii
ggttcctccttcattttcaatattttcttcttttttcgtttctgcatcgtggtttttagtttcacgcattaacgtggtaaagttattatagttcctttcattggaattttcaacctcttttctcgcttcttccagagaaattttatgtacggtctttccaatatcaatcagaatactctcactgagctggcttgccgcatttccaagaaaggtgagaacagacagacggttataatctgtgatatgcatgaagtcctcttcttccagaagttccatcggatcaagcccgcatcgcctggaaagcagatagtaaacactgtctgttgccaactgacggaaatcactgcgaatcgtcacctcgtccagatcttccagataagtaccttctacagcatattccaatccgtctaggtattcctccagattatcactgaccatttcccttgcaactgccatcaatgcatcctgcaaagttgctgtatccttttcttccagagcatagacctctgccagatgggtgaggatctcttctctctggtgttcctgcatctgccaaagatacgggcttctgcccccggctaccatgtgggtatccgaaatatcaaacacataacggagtctggtatgctgccctgtttcatcaagcagggcgattccccttgcaccacggttcacccatcggaacatcttttcattccataattccagtgatgcacaggccgttgcttccggatgctgtgcatggatcagaagctggtctgaaaaagaataacgatataaccttgatgctgtgtccatataatccatccagtctctgggggaaccgctcactgatacagcatgttcctgtgccagatcccggatgtcctgtaatttagacatatcgctttacctccttgtcttatttctttttcttctttgggaattccagatggaatctcggcttgccatcctccagtgtgagtaacagatctgcatcaaatttcatatctttctttttagaatacagaccttttacatgggtacaagccttatcaagaagttctcttgccatctttttatccagatttttctccatgcttcccaagaaacggttttctttccaaagggcaaaatcacactgacggtttgagcagtaaaaattctgtttgccctcgaaaacatcacaaccacagaccggacatttgccgatcacttcccttgcagtctggaatctcctgcgttcctcttctggtatctccctgcatacctctaaaatcttacttacaagagaagtaatctctcccatgaactgagtatctgtaatctgtcccttttccatcagcaacagctggttctcccattccgctgtcattactgctgatttcagatactctggcatgacctttaccaattcctttccctcggtacttggcaatatctgcttaccctttctctgtgcataaccggaagaaaccaatttttcaatgatacttgcccttgttgccggagtccccagccctttcttttctgtttcagaatcaaactccttattaccggctgtttccattgcagcaaggagcgtatcttcattgaatggtttcggcggagaggtataatgtatggttttctctgcttttactggaaaaagcctcattccttcttcatacccagcaggaatcgaagtctctttttccttttcctccactggttccgctttgacacacagctgtttaaatgccttttctacttccttaaatcccatctgtactggaatcttccctctggctttaaaatcatgttcctggcactttaccgtaatatctgtctgctcatacagatattcttctccagttgcctgtaccagctgctgacagatcagcatcatcagattctttttatctgccggtaaatcagcaattcctttctccacgacttcttttgtcggaagaatcgcatggtgatcagatacctttgcattgttgattaccctttttatgccatgccccaactgtccataatctacaaacgaaagtaatactggcattttttctaccagttcctctaccgaatctttcatatcctccgttacaaactgactgtctgttcttggataagtaaccagcttttcttcatataattcctgtagcatatccagtgtacgtttcgctgtatatccaaagtaacggttggcctctctctgcaggcttgtcagatcataaagtttcggtggaaatgatttcttacgttctttcttcatctgtgtgaccacagcggtcgaaccattacataacgctacaagcagctccgcagcttcttcatttgcaatgttctcggaaactactgtaagttttccatctgtcagtgctaccttataaaacgcttctttttgaaaatgctcgatcctctcctgccgttctgcaagcatggcaagggttggggtctgtaccctgcccacaaccaatcgtttaaaatatctcgtggtgtatgctctggttccattcattccaatcagccagtcagcctgtgccctgcacaccgcagccatacagagattcttatattcttcctcacttttcattgtctgaaaacctttctgaatggcggcatcttccatcgagctgatccacagacgtttcactggtttcctgcatccggcaagcacatacaccctttgaaagatcagttctccttctcttcctgcatcacagccattgaccagatactccacatcacttcgattcatcagagtttttatgacttcaaactgcttctttttatccttggaaactttcagcttccatgcttctggaaggattggcagatcatcaaactgccatttttcatatttcgggtcatattcctctggctgtgcgtattctgccagatgtcctaagcaccagctgacaatacagctttctccctccagataaccgtcctccctcttataagcggacagatttttcgcataactttgtgctacacttggcttctctgcgatcactaaaaatttagacataatcctttcctttctaccaaaaaaggcagccaagatttctggctgcccctgtccttattactgtttccatcttttaaaaacgcttattcttctttttcatcgtcctcttcatttacatacggaccgtctgaaaattcaagctgttcacttacataatcttcgtccttactgcgtccatgtttcttatagactgcgattcctgcaaagcctaagattgctgcaactacgatagctgcaagacctttcacattcattccgcttttctcttctttcttcactttggtttcctcctctgctgctggtgtagtctccggtgtggtttccgggatcactacggttgatttttcagtttccttgtctttttctgtttcatccagaaattctgccagatcgttctcatcaaccagagacatcatatatacgttctctgtattactggaacggtcaatgaccatgtaaaaagtattcccctttttcgtctggatagtaaggaactgttttgtatcatcattttccttattatctacaagctgggcatttcccggtgtagaaaaagcagaattattactctctccggtaactcttcccgtatcctctgctttctccgtatctttattcttttctgttgttgtctcttccaccaccgctgtcgttgtctcttctgccggtggatttgcatttgcataaacagtagcaatggacgttcccgaaatcattgttaccgccatagcaattatcagaagtttctttaccactttattcctcatcgtctaaaacctctctttctgccacctgccccacaggtggtctgttatcgctttctttttggggtgtctccttggtatcctccactgtgataccgccgtcctcattcatctgaatcgtaacggttcctttctgaatcccgtcaagcagtaccagtaactcccggctgtccagtttcatagaacggaaagatttgatgatctccacatcttccatctgttgttttaatgtattctgccgtttcagatgttcctgcagctctgcgatcttatcctctgtcttctgaatatcatccagaatcttttttaatttcatgttcatctgcctgtcacctcctctaatgcagacgaccaaatgccataaaatgttcctgccagtaggcacttgcgatacttgtatattgcaccggcttaccacaatggatcatcatgttattgccgacatagattccaacatgactcgctccacttgtgttataggttccctggaagaagatcaagtctcccggttttgcttccgatggagatacctgcgaacagtgagaacgaagtccatcggcagtacatcttccaatattccatccatttccacaattattgataacccagcttacaaatccggaacaatcaaatccacttggggaatagccaccccagacataaggaactcccagatatttctctgcttcccggatcatctttgcaaactgtggatcagataaagcatctgccggtatggtataaccaaaacctccacttccggtgggtatgctgtttaagtcaaacaggtaatcacgatttccataatatttgttatacgcatcgtatctttcctgttcttcttccgtcatgcggcttctcaatacggtatccagattgcgatttgtcatcgtcacatccagacggtttacttccttcgttgtcgtaacctgcacttcctggcttccattgctgtctgctatgtatgcctcccatgtctggtgcccgtgtgcggaagctgctgcatggttatcataataaacatcaaactgaacaccatatcttgcaaaagctccggtatcttctactacatattccacaccattcataatgacatgggttcccatcggtacaaaaggatttgatgcatctactgcgatcgtatgattggctgtcggcatcgcaccgctggctgtcggtcctccactccactgcccacagcagatggagcagttacaatacccactggtgacaacctgtcccagtgattctcctacccggactgtctttgtttcggtaactgtctccctggtagaatctgtcgtaatcccatactgctgacggaaaatggactctatctcctctgccacttcatcataagtaaaaccaccgtattttactgtcagataagagatcagctgatatggattatggccaatctcatcaatctggtaccggtattcatcgtaatccggatgcgtggattccatctgattgatctgcgtatttaaggcttcttctaatgcccggtatgcattttcagcggcataaatgtcctcatctgtactggaataactggtggaaataatggcagacgaagctccctgcagggatgcactgcagctggtaaaacttgctgcaatcaagacaaagatcaatccaaagatagcaactgtagcaaaaatcccacggttttgtgccgcaatcattttgaccgcatctttcgccttttctgtaaatttctgtgctgaagtaatcatggcatcctttgcctttttactctgctttgctgcctgatactgtttctgatagcgtttcttctggaacagtttttgcaatgcagattttcttttctgctccgcttccttcttcaccatcttttttgcttcatttccataaacagattcaaacatcagcctgcttttttctgcttcatcaagaacgctttctttcagtctttttgactgttccctcctttgctttaagcgttcccttgtataaatggattttcttgcaaggctttctcctgcaagctctgcccggtgtgccccttctaccgcagcattatcatcttctgcctcatgggttttccaatgagccgccgtagccgcagcatctttcacggcagatgcagaacttcggataccgataccggctccatgtaccatgccatcactttcatcgccaaacgataatctggaactctttttccgctgttctttcagcacacgttcccgcttcgatttgcctttgatctcctccgaaaatccatccagagactcttctgccacttctgaagtttccctgtaccgggcagcttctctctttgccgtcttgctttcttcggaagcctccttttccttccgtctttcttttgacgcataatctctgaccatctttttcttacggagatcccggctgtctgcaaccgtttccagataagcccgttctccccttggctgtccacggatgctctcactgcgaaatgcggatttcgttgcagctgtgctttcatcggctacttgttccccatccagttctctatctatatcttgttctgactcctcatccagtacagattctctactatatctggtttttttggaactttgctccggatgttctgtttcccttttttcattgatatgctcacgccttctcttactgaaatccagctcatcctttttttcactacgggaaacctctgtatccatatcccgtccagtgatccttttttcttctttattccgaaggttctcttctctaagaccatcacgactcatcttctggacggttttatctctcgccttatactcatgctcctgcaaatctcaccatcccctttactgtttacctgttattctgctttatcctgatagctctcccatttttccagtacctcatctgccagtcctgcaatggaatctgtcagcttatctgtaagtctttcactcaatgttcttcttgcagccaagcaggaagtaatccccataaagtcaatcagttccgctaaatacagcagatcatctaacatctcgccaaacacctcctccccgttactgtcctttcctttttctaaaagttctttataattgtctgcacagattctctctgcaaatacacagcaaggttccccattgcatctctcaaaattcgtataatctctcatgtagtgatcctccatttcattcttgggcagaaaaaaggccggaaatcttttcccggctcatcccctgcttttgttctattttttttatattttttaatcgtctctttctccgataccaagttttttacgcttctccacctcatccggcttagaagtcatcaacgcatacagcatcagggaattatcaaatttatccttaaacggaataatggtactgccataaaagaccagtccctcaccttccccactgttggtaacataagaaagctgatgtggtgaaatgttcagctgctttgcaagaatctgcctgtcaccggatgcctggtttaacatcaggataaagtcagaattttatagtgataggtaagcccctgatatcatctcaggcttttcccccacttcacaccgtgcatgcgactttcaccgcacacggcgttccatcggttagtagatttcgttgtctaaacaatcaaacc

SEQ ID NO: 492 - DNA, 7098 bp, Eubacterium hallii
gattttttgcaagcagccagacctgttctatttgtggttacaagaatgttaaaacgaaaaatcttgcgttaagagagtgggattgtccgcagtgtggaacccatcacgacagagatgtaaatgcggcgataaatatcagaaatgagggaatgcggctggtaattgcatgaccttagagaacaaatacaaccgtgggacacacggggatagctcgcttatgcttagcacggtagtgttatcgaacgagaaccaaacttgccgaggatgggaagcccacacatctacagatgggggaggatgtcacgatatgattgaatggtcaaaaaaaggtgggtatcaaggttcaactatttctttttatgattataataatggtaaagtttatgaaccatttcaaaaacaaagaaatgtgttatatggaactcctatttatttaaagaaatctttttggtttttacagggagattataatagtgggaaaattactcttttcaaatattatccagatcaaatcccagagatgattacaaaacttaatatagaagatgtggatctttataatctacgtattattggagaggatgtttacattgtaagtgaggatgacgaatttgtcagctattatccggaaagttttagattttccaagggtgttaatgaaagtgtaagtatgatagcagaccaaaaagtatatctttctgcctgggtagaagaaggctgggacgatgaaaatgattgtgaaaccgaagaatataactattatgaaaaagtagtagagagagactttaaagggaatttattatcagagaagcttggttctttacagcaacactcagatggaacatggtggatagcatgaaaattggctcatagaaatatccctgataaaaattaaaattagcgacaataataaacattaaaaggttagaaaagaaataattaaacaaaataattttattaattcatagcagaaagaaggattaaatttatgtgtacagcagcaacatacaaaacgcaggatttttattttggcagaacattagattatgaattctcatatggggatgagataaccgtaacaccgcgaaactatccatttcatttcagacatatgggagaaataacatcccattatgcaataattggcatggcacatgtagccggagattatccattatattatgacgcagttaatgagaaaggactggcaatggcaggtcttaactttgtaggaaatgcagtctatcaagaagtagaagaaggcagagaaaacgttgcacagtttgaatttattccatggattttaagtaagtgcgcatctgtaaaagaaacaagagaagctttaaacgaaatgaatcttgtaggtaccccttttagtgaacaacttccatctgcacagcttcactggatcattgccgatgaaaatgaggcaatcactgtagaatgtatgaaagatggtatgcatatttatgataatccagtaggagttcttacaaataatcctccatttgaacagcaaatgttccagttaaataattatgtaggactttctccaaaacagccggaaaatcgtttctctgataaactaaactttaatgcatatagtagaggaatgggtgccttagggcttccaggagatttatcttcagcttcccgttttgcaaaagtagctttcactaaaatgaattcattttctggaacatccgaaaaagaaagtgtcagtcagttttttcatatccttggatcagtagatcagcagagaggctgctgtgaagttgccgatggaaagttcgaaattacactctacacatcctgctgcaatacaaataagggaatttattattatacaacctatgaaaatcatcagatatctgcagtagatatgtttggggagaacctcaatgaaagggaactcatcaaatatccactgataaagggagagcagatttactggcagaattaaatctttattacttctagaatttaattccatggaaagccataacattctggagaattcccattcttaccagctgtggatttagattagacagaaaaaagaaaaaatgccctatcccagatgcggcattttttcttttttcgtctacaccaaatctacaaataaagattattctggaacgaattctgcaatctggtcgagcatgtttatttttatttttccctttttcccatccacttttgcgaatgggattacttcatattttgccttttccatgcacttaccagggtcgtctgccggttcttcgttgagaaagattttttcagctccgccacttaactggcgcttaatattttttaccatgagacgatcataacgctcacaggctttttctgcttttttctggttttcaggatctgagaaatattcttttgtccattcttctaagtttgcaatttcaatcatgatctacacttctcctttgatttttatgtctgattatcttttattataagataaattttacagacaatataggaataataccatttatttatagaaatattacagattctattgtgaatcatggaaagacaaaaaatcagtgtcatatttccctattttatgaaaggattatccaagagtgaacggaattggtttgctataatgagaataattattgatattgtagaaaactgtgctggaatgttttttaacatactctggagcaggagtactgcgaattgggataattgcgatgaataggaaaacttgttaggaaaatttcatgaaagaatgaaaggaaaatcaggaggaggttatataatgtcagataagatttgcagcagtgcggataaggtgctagaggtatttttagagaatgcaccgatggatacttcacatcatcgtatggtgaagcagcagaataagtgtggatatggattacagggagtatgttgtagattatgttcgaatggcccatgtcgtttatcaccggcgaaaccaaaaggtgtatgtggagcagatgcagataccattgcctgcaggaattttttaagacaggtggctgctggttcaggatgttatacgcatgttgtagagaatacggcaagaagattgaaggagatggcacaggaattacaggcggaaggcaagaaaccaaaatataaggactctgttgcgaagcttgcaaagattttacagattaactgttgtggtaactgtggaccggactgtcataacagttgtgcgaagacggcagagatgattgcagatgcagttcttgcagatatcagaaaaccgtatgatgagaagatgacactcatgaagaatattgctcttccaaagcgttatgaactgtgggagaagcttggtattttaccgggtggagcaaaagacgagatttttaatgcggttgtaaagacatcgacaaacttgaattcagatccgatggatatgctgttgcagtgcttacgtttaggtatttctacaggtaattacggactgattcttacaaacttgatgaatgatattattatgggaccaccgcaaatcagtatggatccggtaggttttcgtattattgatccagaatatataaatattatgattacaggacatcagcagtcaatgtttgcagatttagaagaaaaattagaatcagaaattgtacaaaagtctgccgagcttgttggtgcaaagggaatccgtattgtaggctgtacttgtgtggggcaggattaccaggcacgttccggctactataaagatgtatactgcggacatgcaggtaataactatacaagtgaagcggtattaatgactggctgtgtggatttggttgtttctgaatttaactgtacgattccgggaatcgagccaatctgtgatcagttagatattaagatgctctgtcttgacgatgtggcaaagaaggcaaatgcacagttattgccatatactgcagaggaaaaagaaaagattacaagtcagattatcgcagatgctctatgtggatttaagaacagaaaagaaaagttatatggaacagctccagcagaaggagaaaagcgtgtcaatgtcatggcacagcatggttttgacaagtccattaccggtttatcagaagatactttagtagctgccttaggtggtactttacagccgctcattgatgcgattgtttcaggaaaaattaaaggaattgcggcagttgtcggatgttctaatttaagagcaaaaggacatgatgtatttacagtagaacttgccaaagaattaattaagaaagacattcttgtattatcagcaggctgtacttgtggtggtttagaaaactgtggacttatgacaatggatgcagtagaactttgtggggaaggattgaaagaaatatgtacagcacttggtgttccgccggttcttaatttcggaccatgccttgcaatcggacgaattgagatggctgcctgtgctttagcaaaagaacttaatgtagatctgccacagcttccagttgttataagtgcaccgcagtggcttgaagagcaggcgttagcagatggagcatatgctcttgcacttggattccctcttcacctggcattatccccatttgttaccggaagccaggttgcggtaaatgttcttacagaaggattaaaagatttaactggaggacagcttattattgaaacagaggtagatgccgcagtacagaagtttgaggatatcattaaagaaaaaagagcaggtcttggaattgataatggaatcaataaaggaggagatgctatatgctaatgaatcgaacgactccttttatggttccggtagatgatgcaaatcctgcgattatcaaagatgaagcattatgtagtgaatgtggacattgctttgcagtttgtgaagaagagatcggggtagcagcaaaatatttattaaaccaaagggaggcttatcaatgtattggttgtggacagtgtagtgcatcctgcccggaaaaagcaattaccggacgtcctcattataagattgtgaaggaactgatccaagatccggaaaaaatcgttgttttttctacttcaccatctgtcagagttggttttgcagacggctttggaaaagaaccgggaacatttgcgcaagatgagatggtaggtgcattgcgtgcgcttggagcagattatgtatttgatgttacattttctgcggatcttacaattatggaagaaggttctgaacttttgtctagaattttaaaggggaccggaccacttcctcaatttaccagctgctgtccagcctgggtaaaatacatggagaattttcatccggataaaacgaaatatctttcttctgcaaaaagtccgatcggaatgcagggagcagtaatcaaaacatattttgcacataaaaaacatattgatccggaaaagattatttctgtagcagtgacaccttgtacagcgaaaaaggcagaaatagcaagaaaagaattatgtgatgcgggaaagcttcttaatatagaagaaatgcgtgacaatgattatgttattacaacaaaagagctggtacagtggtgtaaagaagaaggaatggatttagagaaaatcactccttcaaagtatgacagtgtattaggagaaggaactggagccggaatgattttcggaaataccggcggtgtaatggaggcagcacttcgaacagtttacagagttttagaaggcaaagaggcaccggcagatttttatcagcttcgtccggtaagaggattaaataaccgaaaagaagcggaagtgacgattgcaggaaagaatctcagagtttgtattctgtatggaacagcggctgcggaagaatttctggcagaagatatgagtggatatcattttgtagaagttatgacatgtccgggaggctgtatcagtggagcaggacagccagattgtggaagtgttccggtatcagatgctgtaagaaaaaagagaatcgcatcattataccaggctgatgaacgggcgcaatacagaaattccatggataatccggaaattggaatgatatataatgaatttttcaaagaaccattgagtcttttatccgaaacacttttacacaccacatataagagtgagtaaggaaaaaagagtgcaaaatagttcaaaaatgaggattaaattttccaactaaaaaaacgatgcgaaatgagaaattcttgcctatattttcttggcaatgataccaatttgtttcatatcgacagatgtaattcgttgctgttgcaataaaatgtgacagcaacgtttctttttgttgtgcaaactgtataaatgtaaaaaatatccgattgataattgccacatactgacacggatattcctaattattgattattttttactgtataatgcaagacagatgaaagctcagtagtggttgatttacaggatttataggataattttttgagttatcatctctcaaacattttcattgcacatttttatgtgtcagtaagaaggaggaaaattgtaatgattgcaaaaggatttacagaaccaaccgcacgtatcaaagccttaaaagcagaagttgttaacgcagtacctgaagtagagccatatagagccgtacttattacagagtcttacaaagagacagaaggtatgccagcagttatgagaagagcaaaagctaacgaaaagatttttaataatcttccagttgtaattcgtgataacgaattaatcgtaggtgctctttccgtaaaacctcgttctacaaacctttgcccagagttctcatttgactgggtagaaaaagagtttaagacaatggcaactcgtatgtgtgacccatttgtaattactgaagaaacagcagatatccttcacgaagtatttaaatactggaagggtaaaactaccagcgaattagctacttcctacatgagccaggattgtcttgactgccaggctggtggagtatttacagttggtaactactacttcggtggtatcggacacgtgtgtgttgattacggtaaagtattaaaaatcggtttcaagggcgttattgcagaagttgttgaagcaatgaacaaacttgatgcaaatgatccggaatgtctgcag

SEQ ID NO: 493 - DNA, 7034 bp, Eubacterium hallii
gaagatgaaatggcaagactttgtggattgcgctaacgaataatgcacatcttttagtagaaaaacgtcttatttctcagcattctttaaaatgattaacattttggaatgctgagtataatgcttctacttctttggttgtccggtcttttaaaatcccttccgcatccattacctcccgatcatgcagcaatgcgtggctcacttcatggactccggttttcatcgtctggacattactcatattttcctgaatcgctatatatttttctgtctgatgataatacccctttgcttccccttctatctccatcatgcggattggcacaggggaaatgttctgcaatgcttccatgaacgtgtcataaaactgtacgctcccggtaagttccggtacttccagttctgcaatcggctctccctctgtctggctgacatcaaataccgttgtcacacggaaccttggaatgaccatctccacgatctccgtttccggctgaccgtcatccccgatcaccggctctttggtcactgggtcgatcttttcaatctcctgtttctcacggatgggtgccggtgcgatgatctgtattcctttttccccacgctttacatggcggttaaatttcttctgccacgcctgataccctgccaccagagtagcctccggtttctgcatggtgatcagaagggtattattaaaactgtaattatggaacttggacatggtattcagatattctgtatatctctccgaagtaaagatttcttttactccctgctccagccgttccgatatttcttttaactgtttttctatattatttgccataaacaaaccctccattttatgtccccgccagagaaaactctgacgggaaatcttttataactcctgttcgtgttttttctttgcagctttctgtacagatggctgttccgctgtattctgctgtgccttctcctgctttaatcgttccagaatagacggcttatgaattctgtctgctgtttccagaagttctttttcttctacggcatccctgctgtccgtgctatttccttctctgccaatatcctcatctgccataatcgtctcattacccttttcatccatgttcagcaatgcatttaactcggataaccgttctatcttttcattcagctctgcttctttcgggaatggcttctttacctcttcctgtgcagtagcaagctgctgttgtacggtttctagcttctgctcactttccgtcagcttcctgtcaatggaagaaagcgtgttatggatacgctgcatatttcctacagggtcttttccaatctccagcttataagagcattttcctttgatcgtcaattcaaacgcattagagaacatattgtaggaagcagataacgcaaacccatgatattccccgacctttccgccggtgctgacagtttttaaccctgcacaggcggcgatcaatgcctcgcctgcttctttcttatcttcataaaggacattccctaccgtcatggcaaacgtgtcattatcctgtaaatccacgctttttactacctgcgaatccacctgcattccggcaatccgctctttcaatgcactgatctgtaccgggaaattctttgcaatatcggattccagacggtaaatctgactggtgtggtttgcctttagaagtttcagcttactcacctgcacatccagatccattttttctttaatgtacggattgcctgtagcaagtgccttgatctctgcataggacaatgccgtatcatccacatcttcacaagctctgaccggggatttactggtcatgatctggctgatgaacttctgcttattctccagaatctgccacatatacgcatcaaaagtgttctccgtcacataccggaatatctttactttgtcattctggtttccctgtcttaaaatacgtccttcctgttgttccagatcagacggcttccatggacagtcaaggtgatggagggcaatgagcctgtcctgtacgttggtaccagcaccgagttttggagtggaacccataaggattctcacctgtccggcccgtacctttgcaaacagttccgctttctttgcctccgtgttatattcatggataaaagcaatctcttctttcgggattcctttttctgtcagtttgttccggacatcatcatatacgttgaaagtcccgtctccttttggtgtggacaagtcacagaagatcagctgggttgtccggtctgcttttccttcttcccatacctggaaagcattttccacacaggtattgaccttgcttttttcggcatccggaagaagttcattcaaaagcctttggtctaacgcacactttcttccgtcgttggttatcttgagcatgttatcctctgtcggattcacaagaccgcctcttacactttctgcacgttctgaaaatgctgctaccatatcctgctgttcttcacttggcttcaagacttcattgataaactctgcttccggtacgggaagattcagcatatccgaagtctgaatatccgcagcttccttaaaaatggagatcagctctggaagattgaaaaaacgggcaaaccgtgttttcgcacgatagcccgttccttccggtgataattcgattgcggttactgtctccccgaacgttgccgcccaggaatcaaagtgtcccatacccatacgcatgagtgtgtcatactggagataacgcatgatagtataaagctcggtcatactgttcgatacgggagtacctgtagcaaaggtgatccctctgccgcctgttagttcatccatgtaccggcatttcataaacatatccgaacttttctgtgcatccgtctgtgagatacccgccacattccgcatttttgtatacaaaaaaaggtttttaaaactatggctttcatccacaaacagccggtctacgcctaactgctcaaaggttactacatcatcctttctggtctggtcattgagtttcttcatcctcgcctgcagactcttctttgttttttccaactgcttgatggtataattctgccctgcctgatgtgccgcttcttcaatggagaacgtaatatctgcgatctgatcttccagcatggcaatctgccgttcccttgaaagagggattttctcaaactgtgtatgtccaatgatcacggcatcataatcccctgtcgcaatacgggaacagaaacgttttcggttcgccggctcaaagtctttcttcgttgccaccaagatatttgccccaggataaagtcgtaagaaatcactgccccactgctcggtcagatggtttggcacaacataaagattcttctgtgagagtcccagccgttttgattccataccggctgcgatcatctggaacgtctttccagctcctacgcaatgagccagtaacgtattatttccatacagcacatgagccactgcgtttttctgatgcggcatcagggtgatctccggattcatgccaacaaactgaatatggcttccatcatattcccgtggacggatgctgttaaatcgttcattatagatcttacagagatcttcccgtcggtgcaggtctttaaatatccactccttaaattcctctttgatcagctcctgcttctgctgtgccagcattgtttccttccggtttaattcccggtgttccccatcggcatcctgtaccgtgtcataaatcttggtatcccggaggtttaaggcatcttccaaaaggcggtaggcattggctctctgtgttccatatgtggaagtaacaagggcatttccgtagctgtccacattttttcccataacattccactgtccggttacttcggcatactggactttgaccttgctccctacataatatcttggagtgtggaatgtctctgccataaaccgtgtaatgtaatcctcggagatccaggttgccccaagtcttgcttcaatctctgatgcatccagatcttttggctgtacctgctccaaatactgcacgttcacctgatattccgggtgatcttctgcaaactgtttggcgatctgcagtttctctcttacatttccagaaagatattcgtccgatggctcccatttttcaccaatcgggttcttaaagatcacccctgccagttcttcggtaagctcctcttctgttttcccggaaagctgtgacatataggaaaggtcgacgcctgccctctcaccgatagaaaccgcaagtgcttcactggcagtatctacagaagttaccgtttctgccctgcggatcgtccgcttgctgaaaatatccgctttccgtttcagttctcccttatcatccagaaattccagagaagtcaaaagacaatagctactgtcctggctaaatgcccgcttattggcattactgctaagcagaccatattttgctgtaaaggtatcgtattcttcattgagttttccctgcaactttgtgatttgttcatcgcttccctcttccatctggcactggatcagttcattcgtaacatcacgaatcttcaccatccctttgacacgttccgctgtcattgccggaagttccatccgattcatcacagaattttcccggtaatagacttcatcattcactacggtaaaactgaaatttttcacttccggatttgccgggatagaaactacctcttcttccagctctgtatcagaaagctccagttctgtgatcgtgccatggatattcctaatcgcttcttttaactgttcttctaaggtaacgccttcttttggttttacagtcacttcctgctttccatactgggtgctttctgtggtaaattcaccaagcaccatttccggatgctctgcaaaataagcattgactgaatagccttccggcgtttcctttaaatttaaccattccggttcctcaatggatgccctgtcccttttctggaaaaacaaaatatcagaaacaacactggtattagcatttctctggaacgcattattcggtaatcggatggctccaagcaattctgcccggtttgcgatatactgtctcactgccggattctgcttatccatcgttccactggaagttaccacaaccactacgccaccgggacgcaccagatcaagggattttgcaataaaataatcatgaatcataaaatgatggcggtcatacctgcggtcactgacctgatacgccccaaatggaacattacctatcacgcaatcaaaaaagctgtccggataactggtttcctcaaatccctgcacggcaatcttatttttctggtaaagctgttttgcgatccttcccgaaaccgggtcaagttctacaccgtacatattggctttgcccatactctccggaatcagtcccataaagttaccgacaccacaggacggctccagaatatttccctgtttcagtcccatattttccagtacttcatacatacttcggatcacggtcggggacgtataaaaagcatttaaggtcgatgcccttgctgcactgtattcttccggcgataaagtattctttaattccagatactcattcgcccagctgctgttattttcctcaaatgcctgtgggataccaccccagccaacataacgggataatatttcctgttcttcgggtgttgccagacgttcttctttctccaaagtctgtaacaaatggatggcttccatatttgccttatactttgccttcggaccgcctgcaccaaggtcattatcctggatacggaagttgtgtggttctatcacggctttttcctgttctggtttcaaatatggctgaaattctccctcatatccaaacagttcattttctccgggaatataattgcgtccggtttccaggcaccggaacacatcggcagttggtgcattgctgactgcataaaaatcatcatacgaatatttagggaaatcttctgtatggtaggttgataaatgcagttctgtattggaacgggtctgtgcaaccagatcttttccctctagtccttccggcaatacccctactgcttcaaagtgatacccctgatactcaaaaacaccctcatcccaggactctgccagttcttctgctgttttagctgttgtctcttcttctggttcagttggttcctgtctctcagaatctttcgttgtttcctgttcctgactttccagaatagattcttcggcagtaacctcttcctcttctatttcctccacatctgacatatctactacggtcggttctgccactgccttcgtatccaagaaatcaaacatggtcatctggtgccctgacggttctgtaaagaatggttctgcttctggtgtcgggaaaatcgtataggttccctctgcatactggtggagttccgaaagaagttctgttttctgctggtagtttgtcccatacgcttcaaaatccaatggaagagctgccaatgctgcatccatcttctgtaacagttcttctgtctgctctggattctttaatactgcctccatttctttacctggtttttcccagaagaaatcatccgtaaatggtctgtctatctcttccggaagacggtcataaaagcggagtaccttattcgccatctgctcccgttcatattccggcatacgagcataatcttctgcctgcaggaactggtcattctttatcagataagctactctgtttgcaactttattccaggacaataaaattgacgtatatggattcccataagcacctcttgcaagaaacaatccttttccatcatagtttgcgtgtgaatcatcggcaccggaaagtgcatgactgcttccaccaatcccatactgttccttgataaaacctgtcctcgctctttcatcctcatgcaacagataaaaggaatacgtcctgagcctgccctgcgaatacgctccacctcctgcaagataagcatcaatctcatcctgcgtaatgaacatcggatgttctttccatgcaaacccgtcc

SEQ ID NO: 494 - DNA, 6841 bp, Eubacterium hallii
acagcttcctgtaaaagcagaaataatatttcctgccgcacaggcaaggatttctttattatcatctattttataaccatttttcgaagcaaaattattctcggaaagtaaagtttctgccataacaacaacagcaatcatcaagccacgacctgctgcatgcttaaggtctacgtgaaatacagacggtataataaatttaggaagtcctggctctactttcgatagtaaagccactccataatgatccacatgaaataccaatgtagaaaccattccaagagccatgatcacaactgccatcggaaacttcggcattacttttttagaaataatcagtattgccagcgctccaacacctaatccgaccgatacccaattaatatgcagcgccgtctcatataaatgctttaacagttctggaagttcacctgaaccggatttacctcccataatctttggaatctgcatcaagataattgtcagtgcgattccgctgataaaacctcccataaccggagttgaaataaatgtaacgagcttgcctgctttcaaaaaataaaacaaaagcagccataaaccaacgaatagtgaaataactggaatataccggagtgcatccgcactcccactctcaattccaagacttgcaagcgctgctcccgcgatggccgctggtgccgcatccactccaaaaataaactgaggagaagtggaaaaaagtgcaaaaaataaaataggaagtacagagccatacagtccaaaaactgctggcaaacctgatacttccgcatatcccatagaaataggaatagaaacagccgcaatcataattccagctgtaagatcttttccaaaatattcttttttataattctttaatgtaggaaataaagaaattttcataaatcgtatgccttcctttctataaaacttaccatataatatagaagattcttgaggcaatgtaaagagaagaagaaaagatctatttaacaaactttccaaatacatttctcaccaatggtcctgcaaaaaaaatctgccagcacagtgccattgggaagttcattgcagttgtctgtaaccagacagctataatttcttttcccggatgtttaaataataccgttgcaataaaactcattgacggacacatcagacaaacaatcattgatgaaattgcaaggataataaaaatcggtttatctgttggggatacaatacgaaatgcaagaaatttagataatttctctacgacaaaaaattctaaaataaatgctgcaggccacataatcggcatctcgtaaaatgcgagtaagaaaatctggttactcatacctcccttatcaatagaaatgttgtagcaaaccatagcatagaccatgacaaaagccatgatgagtgtgaaaataacgttctgtaactttgtttttggcataatcagccgcctccttttattctgtctaccgaaaatttacttttcgatgaaatagtataaaaataggatgtgttgttcgttatcaatattttttcaaaatactgtgcgtttccaattagaccaaaatatttttatgatattttcttgatacgagtcggtattatagcataaaaattttttttgcgtaagtacttttttatttttttatttaggacatactataaaaatactgtaaaataggtagattgcccaattatatgaccattttatactactttatagtaattctttatcactacaaagtgccataatacgcaaaaaaagtgcatttttttacctttatttcattttatataaatgttataattgttatgtttttgtaaggaaattgtaaaaaagaaaggataaacgtaatgaaggaaaacaaaaacgattttaaaccgtatattcctgcggaccaggtagttccggaatttacagtcacagccttaattcttggtattttacttgcagttatttttggtgctgctaacgcatatcttggacttcgagttggtatgaccgtttccgcatctattcctgcagccgtactttccatgggtattattcgtatcattcttcgtaagaattctatcttggaaaacaaccttgttcagacaatcggttcagccggtgagtctgttgctgccggagcaatctttactctccctgctttattcttatgggcaaaagaaggtaagattgattctcctagtattttaactatctttttagttgcacttgttggtggtatccttggtatctgtttcatggttccacttcgtcaggctcttatcgttgaagaacatggtgttcttcctttccctgaaggaactgcctgtgcagaagttctccttgccggagaagaaggtggtaacaaagctggtatcgtattctccggtcttggtatcgctgctatttacaaattcatcgctgatggaattaaacttttccctagtgaaattggttatgatattcaggcatatgccggttcttccgtaggtattcaggttcttcctgctcttgcgggtgttggttacatctgtggacctcagatttcaaaatatatgttcgcaggtggtactttaagctggtttgtactcatgcctatgatcgcattatttggtaaagatgctaccatcttccctggaagtgaagtaatttctactcttgctccaggatcattatggggaacttatatcaagtacattggtgccggtgccgttgcagctggtggtatcatgagcttaatcaagacttcaccactcattgtccgtacatttaaacaggcaatgggcagcatggctaaaaaccgcgctactgctgatgcttcccgtactcagcgtgacttaccaatgccaattattcttggtattatcgctgttatcgctgttgccatctggttacttccaattttccctgtaagtttccttggtgcagttctcgttgttatattcggattcttctttgcaactgtttccgcccgtatggttggattaatcggttcttctaacaatccagtttccggtatggcaattgctactttaattatttctactttaattttaaaagctacaggaactacaggaactacaggtatgatcggttccatctgtatcggtagtattatctgtatcattgctgctatcgccggcgatacttcacaggatttaaagacaggtttcattgtaggtgctacacctaaacttcagcagattggtgaaatggttggtgttatcgcttcctctgctgcaatcggatatgttttatatctgttaaatgctgcatggggattcggttctaacgagattcctgctccacaggctactatgatgaagatgctcgttgaaggtatcatgaatgcagaacttccatgggcactgatccttgttggtgtattcatcgctatcgttgttgagattcttggtattccagtacttccatttgccgttggtatgtaccttccattctcactgagtgctggtattatggcaggtggtgttgtccgttggattcttgaacgccgtaaagcagcgaatgaaagcgaagaaaaagaaaagaaagcttgcatcgaacgtggaacattatttacttccggtctgattgctggagagggactcatgggagttatccttgctatctgtgcggtagcaaaagttgactctaagtttgtttcccctgttgcccttccacagattggcagcttagttattttcatcattttacttgcttatttatacttcttatgtgtaaaaaagaacaacaaaactaattaacaattaaattacaaaacatatttaatttctggcagtgagagaacctctttcactgccaaaattattgaatcacgcgccaagtctcgcggctgctcgacttgaaatatacatttgattttaataccaaatcgttataaaatataaaatatttcaacattatgggagcagcattcgctgtggagtaattcgtgacatcatgctgggagcaaaataccttttgatcctaacatcactgtataatttaatttatataatttaattatagaaaggattctctatgaccaaacagaaaatagataaaaactatcttgactatattcctgtcaaaaaccctgagataaaatatgaaaaaaatgaaaaaggaattatcactgtttttattcgctgggaaggtttctttaataagattgctcagaaattttttcaccgcccaaaagtaagttccatcgatcttgatgattacggaagctttgtctggggcatcatcgatgacaaaaaagatatttacacactttcaaaagaactcgatcaaaagttccctaacatggaaaagtccctgtcccgtctcatcaagttcttagaaatattaaaagatcatcatttaatcacttattccgaaaaaaagagtaattcaaacataaaaacttgctagaaatatccagtaatatgtataacacagatttacgattgaataaatatgaaaggatcatactatggaattactgaaaaatctgttacagtatctcccttatattttactctttgccgtagctaccatgttaatctacggctggggattatggcgttccctgcaccagaaacaagatttaaataacttattgacctcaaaaggaatcagtaaaataaaaaaagaactaaaacgtaatgggaagatgacaaaaaaagaactcgccgactgtatacaggggctcaccgctcaacagccttttagcaaacaacgcatcggtgtcaccaatcccactcagtttcttgactcgctccttccttacatggagcgtcaggaaatgataacaaaaacaaaagaaaacggaaaggtatattactatttgattcattgagagagaacagacgaaaaaagaaaccataccatatcccatctgctctgtagtcgctgtatttaagatgctcatccgcatcttaaacacgctccgaagccgcatctggaatatggtatggtttcttttttttgtgttttggctccagaaggaaggaatgcaatagtctttgggagggataaagggggagaggtcagaagactactgtttactcgaaaggtatatcgtcagaatagaaaagtgatatattgcaataatataatgatgaatttatcatatacagtaatagcttgcggtatcatcttgtcatcagtgaaacttgaaaaaaggttcaacatagtggaaacagtatcagaataagccataatcatctgtcttctacccttgttttcccaaaaactattgcattcattccagagtcaaaacacagaaaataaaaaataaaccatcgcaaatgtaatgtgagagcaagtaaaaatgccgaacaggcattttctacgcagtgatatctttacatttgcgatggtctattctttttattttcgtctgttttctattcttcttccgtttctgtttcttcatcttccggaacttcattgtgtacttctgttacctgtacaacagtttcctccggattcgttttcaaatgaatgccttctgtagttgcaattggtaaatctgcaactctgattgtatcaccagcctgtttaccagttaagtcaatctcaactttttcaaccagatcctccggtaatgcttcataactgatttcttctaataataattctacaacaccagattttaccttatcgtgatttaaaagtacaacctctgctacagaatgtactttctcaccctttactaatgcctggaaatccatctccacaatctcatgtttcattggattatagtcaatctcttttaataagactggcattgtctctccatcaacagtgagttttaactgacttcccttattacaggttcttaagattctttctgcctcttttttctcaattttcagcggcatggagccttccatgttcttaccgaacacattgcctgtaacaaatccttcccttctaagcttttttgccttaatctgcatatctcttttttcagcacttaaagtattcatttatcttttcctccaaaatgtctgatgcttagaggccctactttatcaggtctgataagtattttacggttatccttttcataaccacttctttgttacggtgctaattatagcactactgtcaaaaaaaagattcacaaatatttttgtttttttaattattttttatgactttttaaaaatatctttaaaattcacagacaattttgtttatggattttgtatagacaaaaaaagaacaaataatatatcccatctgctctgtagtcgctgtgtttaagatgctcatctgcatcttaaacacgctcccaagccgcatctggaatatattatttgttctttttcctgactatgctaaatccacagttgggcaacatggaatgtaccagaaggatatcactgtccgggaaattaaagcttaaaggattgacgcatttttctggagttttccatttgaatagaactcgtagaccgttggagaatcccctcgttttttgactgatttgtagaatgatgttagatagccgctgtaatagaactttttgctgaaatgtaaggaaactatagcaaagaaaagaagattaaataccattcagtaacatacaacaatttaaatgtcaatcctttagactttaatttcccaataatccataatcttctggagaattcccattcttaccaactgtggatttggagtagtcagaaaaaagaaagaataccatatcctagatgcggcttcggagcgtatttaagatgcggacgagtatcttaaatatagcgactacagagcagatgggatatggtattctttcttttttcgtctacatcaaatctacaaatcagaagttgtgtattcttttttcttctgtta

SEQ ID NO: 495 - DNA, 6813 bp, Eubacterium hallii
tcttgcctccatcttttctgtctttgctatcttttctttcttgccagtatgtttactttccggtaaagcatacctttcactaagctccatatattcatgttgaaattcttcgctgttttcttcttttagtatatcaagatattcatgggtgtcaaacccaccctcgtcaacctgtaacaggcatactgcaatattggaacaatggtcagcggcacgttcaaagtttgtggaaatatccgacaaaataaatccaagttcaatcgtacatgttccagtgcgaagcctgttgatatgtctttgcttttcttctttatttaaggcatctacaacctgttctaatggttctacttcttttgccagttccacatcgcctgtctcaaacgccatcactgccctgtctaaaatatctcggattgcattagaaaatacacgaagttcctgttttgctttttcagaaaatttcaggtccttcttatgcatttccactgcggcatctctgatatttacggcatgatcagaaatccgctcaaagtcaccgatacagtgaagcagtacggataaaacccggctgtcttttatcgaaagctcccgcccacttaattttacaagataggtaccaagcgcatcttcatactgatcaatctgattttctaatttttctactctgtctgccgtcttgtcactgtattctccaagcagatcaatcgcaagattcattgctttttgtgattttcttgccatattaatcgcaacactacgacattcttccatcgcaaatcccggtttatctaagaaacgctcgtccaatctggcaagatctggattgattttttcttcttccatctcttccatttcagattctttatccggaatcacaaaaattgccattttttcaagcagatttgcaaatgggaataaaagaatggttgcgccgatattaaataaactgtggataactgcaatacctgccggacttgcagcagtatttaaaaactgaaaatgaacaaatacatttaaagtataaaaaacaaccataaagattattgttccggtaatattaaagaaaagatgtactgcggctgttctttttgcatttttacttgtaccaatactggaaataatcgctgttatacaagtaccgatgttttgtcccataataattggaagagctgtactgaaattaaccgctcctgtggcacaaagtgcctgtaaaataccgacagacgcagaggaactctgaattactgccgtaagaatcgtacctgctaacagtccaagaagtggattagaaaacatagtaagaataccggtaaacttttcattatctgcaagaggtgctactgccccgctcatagcttccattccatacattaaaatggcaaatccaataaaaatactaccgatatccttctttttctcgttttttgtgaacatgataagccctacacctatcacagctaagataggagaaaatgaggacggcttcaacatctgtaatacaaagctacttccctgaatccctgtaagacttaagagccaggatgtaattgtcgtacctatatttgctcccataatgataccgacagcctggttcagtttcatgattcctgaatttacaaaacctactaccattactgtcgttgcagatgaagactggattactgcagtaacgccggctcctaataaaactgccataattctttttgaagtcagtttctcaagaagacgttccatacggccaccggataactttgaaagtcctgcacccattgcgtccataccataaaggaataacgccagtccccctatcatagataaaataccaaaaatattcatattctctcctccgttttacattttacttttctaatacgtagtttttacgttatcatatgtatgtaaaatccaaagagagaactatgtaaagtttatgtaaaattatttcttttttcgacatcctattagaaacatagattctaacaggacgtattaccaaattattgcttttattatactacaatctgtccggtaatagaaaagataacccattctgcaatatttgttgcatgatctccgattcgctcgaaatactttgtaaccattaaaagatctactgcctgttccccttcatcagcatgaactctaatcagtgcaatcagttctttttttactttttcaaaaaggtcatcaacgacatcatcatgtgcaatgactttttgtgctttatctagatccttttctacaaaggcttccagactctgaatcagcataaccatcgtctcttttgccatctcttcaatatgatctaactttttcacgtatggttttttagaaagaactatcgccagttcagaaatatctgttgcatgatctccaattcgttccatatcggttaccatttttaatgcagaagaaatatttcttaaatctcttgctacaggctgctgctgtaataaaagtctaagacataagtcttcgatttttctttctgtacggtcaattttctcatcgcctgccatcgttttttttgcaagttcttcatcttgcttcatcaatgcttttaccgcatttccaatagatgcttcgatcatatttcccatattgatcatttcttcattaagttgttctaactgttcatcaaagcggatacgcatatcaaccaaacctccctgtaatataatcctctgtacgtttatcttttggcatagagaataattcatctgtctttcctgtctcaataatttctcctaacaggaagaatactgttttgtcggaaattcgtgttgcctgctgcatattatgagttaccattacgatcgtgtaatccttctttaattcctgtgcaagctcttcgattttaatcgtagatatcgggtcaagcgcggaggtcggctcatccataagtaatacttctggttttactgccagcgctcttgcgatacaaagtctctgctgctgtcctccagatagacctaatgcactctttttcaagcggtcttttaattcatcccagatagctgctcctcttaatgcctcttctacaatctggtcgagctttgctttactgcggataccatgtgttcttggtccgtaagctacgttatcgtatacactcattgggaagggatttggtttctggaataccatacctactctttttctaagaagattcacatctaaatctctgtagatatctgtttcatctaaagttacctgaccggtaatcttacatccttccactaaatcattcatacggtttaatgattttaataatgtagatttaccacaaccggatggtccgataaatgcggtaatctctttttcctgtatatttaaagatatatcctttaatgcgtgaaactgaccataatacaggttcaggtcatcaatcatcattttatttgccaagatattgtcctgcctttctataaattactgtgcttttgtaatcttctttgcgataaaggaagataaagcattgattgcaataacaagtatcagtaatattaccgctgttgcatatgcctgatttacatgtaaaccttcatttgcaagtaaatacatatgcactgctaacgttctccctgaagaaaatacactgcttggaattttcgctacgcttcctgcggtgtaaatcaatgcagctgtttctcctacgattcgtccggttgcaaggataacaccggaaaggattcccggtactgctgccggaagaacaattttaaaaatcgtacgaagctttcctgccccaagtccaaagcttccttcacgataagaatctggtacagacaataatgcttcttctgttgttcttaaaataactggaagaatcatgatcgctaatgtaaatgcacctgcaagaattgagaatttccattttaatgccgttacgaaaaataacataccgaataatccatatacgattgacggaatacctgttaatgtttctgcggttacacgaataacttttactaatttatttccctttttagcatactctactaaataaattgcggatccgattccaaaaggaacggcaagtaaaagagaaaccgctgccataattaccgtattgatcgctgccggaattacggaacagttttccgaagtgtaattccatgaaaataaatctgcgttaatatacggaataccatttacaagaatatataaaatcaaaaatataagtgccgcaatcgttgctactgcggataaaacaaccagcaacataacgagcaaagaacctggtgttcttttgtaagattttaatctgtcacttaatgacagacgattcataggagcttcgtttatcattgtggctgctttcgctgtctgctgcatcgttcccatcttatttactcatctcctgtcttactctttgtcggaacgcatttttacaatagaaaatgcaaggttgattacaaggataaatacaaataatacaacgcctgtggcaattaaggcttctctgtgaagaccttctgcatatcccatctccattacgatatttgctgtcagtgtacgaacaccttttaaaatgccgcttggaactcttgcctggttaccagctaccatgataactgccatcgtctcaccaatcgcacgacctacaccaagaatgattcctgcaaaaattcctgactttgctgccggtaacacagctctgaaaatacttctctcatgtgttgcccccagtgccagagaaccttcataataacttcccggtactgcacgaattgcactttcagatacaccaataattgtcgggagaatcataattcccaacagaatggatgcggctaaaatactgcttcctgttccaccaaagttataacggatcgtcggtacaatcatcaccataccaaagaaaccatatactacagatggaatacctgccaaaagctctactgccggttttacaaccttataaatcttttccggacaataccatgccagaaaaactgcggtaagtaatccaatcggaacaccgatgataatcgctcctgctgtaacataaatacttccaagaatcattgggaagataccataaatatcatttcccggcttccaggttgtaccaagaagaaaatcggcaaagccgattttcttcattgcaggtattccgtttgcaaaaaggaatacacatattaatgctacagcgagaatggagacacaggcagcaagcagaaaaacgatttccattattttttctttagattttgccatgtctgttctctcctttatttactaacgtcactccatgatgttgtctcaccagtgaagatagattttacctgatctgtggataattcatctacggaattgtcattgtttacgataactgcaataccatcttttgcaattgtcttaccttctacaccctgtgatgtctcatcatcttttaagtctctggatgccataccaatgtcataagaaccttctactgtagaagaaacacctgttgtactgtctgttgtctgaacgtctacctgtatatttgtatttgccttactataagcttctactaatttttccattacaggagatacggaagaagaaccacctacaacaacttttccttttgcaccagttgctttataagaagctgctgcttcatcaacaggaatgtatccgttatcctgtacaatcttctgtccttctgcactcatgatataacttacgaaatcatttgctgcatcacttgcttttttacctaatacaatgttgaaaggtcttactactttgtagctgccattctttacattatctacagaagcttctgcaccatcaatctttacagcctttacagtatcatttaaagagccaagagaaatgtaaccgattgcattcgcatcatttgctacagaagacatcattacggaagtactgtttgtaatacttgcctcatctgttgtcttatctaccttttctccgttctcttcttcttcaataccgaacagttcgataaaagctccccttgttcctgaaccatcttctcttgacattacagtaatagctgcatcggaacttcctcctgctgtattaccacctttgtttccacatcctacaagagtagttactgccatcgctgcgattaacgcgaagctgataaatttcttcataattgtaatccttctttcttactttcttttattttttctttcttaagcttgcttccctcaagcttcctctaaaggatacgggactcatgtaaagttcaaaaccatagttttgtaaaataaaagtaaaaatttgtagatttaatatagacgaaaaaagaaataagaccctatcccatctgctctgtcgtcgctgtatttaagatgcttgtccgcatcttaaacacgctcccaagccgcatctgggatagggtcttatttcttttttctgactgctctaaatccacaattggtgagaatgggaattctccagaaggttattcttataccgcctggatattctttgttgcgattacatcaacacctgttcctgctacgttaggaacgatgacatcaccaatcttaactggcgcttttactacaactggtttaatctcatcgagaatatcaaaaatctttccttttggaataacgtcttttgtctttacggatacggcggcaaggtttccaccttctaccttaacgatcgatgtaactacacgtgttgggtttgttacttcttctcttgcgtatttatctccacgaggacaagtattaccttttacatctgttacttcaccgttttccattgtaactgtaatctggcatccaagaggacatccaatacatgttaagtctcttttttccatgatactac

SEQ ID NO: 496 - DNA, 6419 bp, Eubacterium hallii
cacagcatatgataccgatataaaacatatagataccgtcctgaacactccttttttgatggagatacatggtgttacctataatgacgaaaaagctgctggggaaatgctcgtacaggcctgtacacagatgaagaaagcccatgccgatgcagaaaatatcggaagtttttgggggtttcagatgaaaatatcgtattctttgtttgacaatagcttttatgtaagactgacgagagaagcctcttttatagttgaagttaaaaaagatcctgtacgaaacatcgaacgtatccttaccgcaatgaggaaccttcccggacaaaaaaagacagcagaagaacggctggaagatgcaagacagcagcttgtgcaggcaaaagaagaagtgcagaaaccatttgaaaaagaagaagaactgaagtttatccaagctcgtctggtcaaagtaaatgcggaattagatgtaggatcagacgaagagaaaatacagaaagatgggaagaatcgacaggaggaacagagaatatgcctgtaataagagtatcaaaaatgggaaaatgtatccagaaattaagagaagaacgggggtggagcttagaagaactggcaggacgtatcctgctgtcaccagaggaattaaaatgcatggaaaatggtataaaagaaccagacaagatgaccgtcactttgcttggttatatcctaaacgtgcatgcagacagcctgttaaatggtgagatccactgccgggtgtcccagacagaattaatggagcttatgaaagagaccatagactatctggaagggatacaaaaggagaataaacagatcggagtggatatggaaaagatacaggaaaaatatggactgccagggaaggatatgccggaaagagaacgtacagagaggatgcagaagcaagggcatatctttacaaacaaaatacagaaagaatctgtaccgaagttattatagaaaatgtgctgaatttcagtacggaacaggaggagatacgcatggaagaaaaaagcagggaagttgtcatggcaatatccaatgcagcaaggtatatggatcctttttttaaattatcagcaatggggactatcttattactgcagtattttgcccgtatggtcaaagaacgaaaattaaaagaaacagaatttacggacttccagaaatttttaagaatgacggaaggaaaatatgatattatgaacgtcccggaaatcccggaggaacagttgtcagaagaattaaataccctcggcatccattatatgatacttcctgatctggaaaaaaatgatggaatgctgcaggttgctgtttatcagccagacagggaaaattttggggcatggtatcagcggcatatcttaagctgtatgacagggggagaaaaagacatacaggaactaaggaatcttacttccggaaaaacaacgatagtttcttttccactggaagatgaagaggaattaattagagaggattttgaaaagttaggaattaattattctcgacttcctgatttacatgttggagatggtgaattgcaggttgttatagcaaatgcagatcttccaaaagttgaatcttggtataaattataccgggatgatctgcggaaagatggcataacggatgtcccggatatgaaaaaaatgtcgatggataactatatgcagacaggacagcagacggaagcagaatatattgatacagcttccccggaattaaaggctgttaatgctaaatatgagggaaaagaaaagggagagatcgaacaccaaatagaagcagccgaatataacactatgggaaaagaatcttcgacagcatatttgcggtatgtaaatgaccctgcctatatcccgatcagcattgataaaaaaactctggttgagaaatcctcagtgatcaataaagatggattagatagatataaccagtttgcctgccgtattcctgggacatatggaaagaatgaaaaacaacttgtgatacctgaaacacaggtctttgagacacaaaaaggttcatatatcgcttttctaaataaagaagatccggtatttgtatttaatgtcagaacaaaacaggtagaccatgagatgagaaaactgacgggcgaagaatttgcgaaacaatattttgataaagtagacagaacttcagaacgtaaagtaacatcattaaaaaaatataaagagaaggggaaagatctaagtgaccttaagataaagatgccggatccaccaatcagatcaaaataaaacgtgctgaatttcagtacggtgaccagcagttactaaaaacagttatgtataaacaggcatagctgtttttattttttatatgggcagaaggaaatcgttctcctacccattttattatacgaggagaatatgtatgatacaaaaacgaaaaccaccatgggggatgttttttatcctgttgcttcttgcattggctgcatcgtattatatagcaggattgttcaaactagatgatgtgacgatacagaattatcaatataaattagcctacatattgatgcatccattccgtaactggttcaatgaaaaaacaccagccgttatagggattgccctgactgcatgggcaatgtttgtctgttattatctcacttattaccgtaattttcatcctgatgcagaacatggtgttgcagaatgggcagatgtaccaaagacagctaaaagactgtatggaaaaggggaagaacctgttacctgcctgagtaaaaatattacagtaaatgcaaaggcattgccgaatatgcatatcctgatccttggcggttctggtgatggaaaaacaacatcccttttgatcccgaatatcttactagcgaatatgacaaatattatccttgacgtaaaaggagatttgctgaaaaattatggaggctatttaaaagaaaaagggatagctgtaaaaagccttaattttaaagatatggcacaatcagaccagtataatccattcagatacatagaaaattatacagatatggtagaactcattacaaatatccagacatctgtaaagccaccggatgcccaaaaaggagaccctttctgggatgatggtgtaggattgtatctgcaatccctgtttgaatatgaatggcttcaggcaaaagaagagggaaggacagcctctatgctgggaatccttgatctggtaaacaaggagacacaaaaaacagatgaagaagggacaacgcagttacagcaggatatgcaagagttacaggaaagatatggggaagattatccgccagtgagagattaccgcaagttaaaagaaggtgcatcagaaactgtacgctctattgttatcatggttaatgcacaattacgcctttttgaaatcccagagattaaacggatatttgaaggaacggacgatatagatattccatcgcttggcttaggtgtagatggaaatccagaaaaaaagacagccctgtttcttgttatgccatcaggagattcttcttataatctttttataaatatgttttatacacagttatttactgtattaaaaaggattgcagacaatcgaagagacggacagctgccgatccatgtacggctgtgggcagatgaatactatgccggtcctaaaccacttaactgtgagacacttcttggggaaatacgaagcaggaatatgtccatcgtaccgatcctgcaagatattgcccagataaaaactttgtatcctaatgacaaatgggagatattcacaggaaactgtgcaacgactgtattcttaggctctggagctacagcccatacaacgcatcagtgggtatcagacatgttagaggatatgactatcgacagccgttccgaaagcctgggacattcacaaggcagtggtaatctgcagatgagcaaggccggaatgaaattaatgactccgggacagatcagccggatgccgaaaaacgactgcatcctgttcctaaagggagaacgtcccatctacgataagaaaaactggccgttcaatacagaggtatttaaagaagcagagaagatagccggacaaaatggctataaaaatccagtatatgtttcctatgatgaaagaaataaaaaatatatcacaacccgttttgagtcaagattgaattacatttcaaaagaagagtttacattttttgaagaaaaagcaaaagaagattccagtattcaaacgttccagatagacgaagaagccttcctttaccttaacttcaatgaaactccacagccaagcctgagagaactggaaaagatggtaaaagaaatacaagttgcagaggtaaacgaagaggaagaagaaaaagagatagaccagcagccagatatgctacaggatagagaacaatgggacttatcaggagacattattgattgctttagacgatattccagtgagctatcaccagaagaacaggaagagattataaaaggcattgaagaaggtctgactgatcaggatgtaaaacgatactttacactggtaggtgcagaaaaaatgcggcagtatcggagagtgttgatggtcgcaaaaataagagatgaggataattaaatattatttttgcatcaggcatctatacctgttaggcataaagtgtggactgaaaatgatgtcgtgaaattcgtaaggttagaatcaatgatagagccaacgaaaaaacggtagtgtttttcatagtctctaaacaatactacagtggaatgtctttgtcactgcttttttatgtttacaaagaaaaatcgctgtgcaatagctttcgcaagccatcgcgcagcgattttgttcaatcagaatttattattataaaccctttgcaaccgaaaagtagcattatagttggtggtataaccatagagaaaacattataattaggccatcaaatatagaaaggagaacccaaaaatgaagtatgagctgtatcagtatcttatgactgacttgtggcttgttggtgtagtgattattatctccacataggcgtactgactaccaagtcaccactcctacaaagacatatgttttgaggttttctccagtattaggattaatgattgttgcagaatcacccatccaatccacctcaacttattcgccagattttcggttaatatgcacggtagcacggtgcttataaacatcctgataatagtgtgattatatttttaattttctgtcaccctcccactgtaacaattaacattataagactcatcattgtttaggttgaattgataagtaggctcataatgaaatttatttatttttaaaatatttaattataagaattagtaaacaaataataataactattaaaaacaaatttaaaaaactccagacagaattaaatattacctgagacatactttatacataacctccttttataccataagtgcctttgcttttgctccatttaaattgttgataagcatcacgtcgtgtgatttctatatcgccaagaggggttgttaattctgaaacttcagaataatcacatcgtatggtacaagtttttttggtactggaataagtggttttataagttctgtctgttgctttgaaaccaactgtgagaccggaaaaagttaatttgcggttaaatacttttgaaattttattggttgaggtattgtaggttatatccgcacggagtctaatttttagggttgctccgcgagttccactagcactaattgtttttgattttcctgctgctttcattgaggaaaatactgtttctgatggactactttctgcttcacctagagatatagaattcatatttagttcttgtttttctaacaaagcaactaaatcgttagcattttctatttgtgaagagtaattattagtattttgagtagaagtgtttaaaaaacgaattttaatattatcagaatttttaataatattagatttttctaatgctttataaaattcgttttcaaattgctgctgtttgtcaaattcaagtgttgaagcattaacaggaaatgtatttactaaaagaatagataatattaataatagattataaaaatattttttcatatatctcctccttattaaacataaaaaaatatcaaaagtttttttatttatatatacgttacttattcagatatctgatatttatattatataattaatattatgtattgtcaatattatatttgaatcaaatatattgaaaataaatatgatatgtgttaatatacattggtatttgaaacgaaagggaaatttagatggccaaaagaaactcttttaaaaaagggacaatagaattattgacattagctattttgcaagatggggattgctatggatatcagattacacag

SEQ ID NO: 497 - DNA, 5823 bp, Eubacterium hallii
agaagatgaactgcaggatctcaaagtagttaaacgaaaagaaatcgcacagaagataaaagaagccagagaacagggtgacttatctgagaatgcagagtatgatgcagctaaagatgagcagcgttctatggaagcaagaatcgaagaacttgagaagatcatcaagaacgcagaagttattgatgaatctgcttatgataaagatacagtaagtatcggaagcactattaagttttacgatgaagaatttgacgaagaattagaatatcgcattgttggttctacagaatctgatattcttaaaggacttatctctaatgaatctccattaggaaaagctctgattggtgctaaggtcggagaaactgttcaggtagagagcccagatggattttccagatacaagattttagagatttccagatccgacatgtaaattaccaaatcctgatttgtagatttggtaatagacgaaaaaagaaaaaaataatacatcccatctgctctgtaatcgctgtgtttaagatgcgaatgaacatattaaacacgctccgaagccgcatctgggatgtattattttttttcttttttctggctattctaaatctacagttggtgagaatggggattttccagaaggttatggattctcgggaaattaaagtctaaaggattgacgcatttcttctggatgtttccatttgaaatagaaattgtatacttctggacaatccccttgttttttactgggctgagggatgatgttagacagccgctataatagaacttcttgctgaattgcaaggaaaccatagtaaaagaaagagaatttttataagtattgcattttgtgactttgcgctgtggaattttgactctgaaaacttcggactcgtttttccgaagttttcgttttttgaggcaaaatgaagcgtttagcgcaacggaacaaaatcaaacttataaaaattctctttcctttagaaaccttaatgcaattcagttaagaactactttcttcagcggcgtctgtcgcatccctcctctttcccacagattaaataactgattccatctggagtcaacaaacaggagaacaaaaatattatatgaactagaatgtgatgtcggagcaaataaaaatgccgacgaggcattttctatgcagcgactaccttcacattctagttcatataatatttttgttctccgtctgtttcccctcataaatcagtatatgaaatctttattttaccgttgtaattggaagaaagttcatgttatactaaaatagattaaaaagattttagaaatcgaggaacagttatgattgatccgaagaaagtcagattaatgacgaagttggcggtttatgaagagggtccgggaaagaaggatttgagaataaacggttacagtaagagaacatatgtgaatattaagcagttagaaagtgtaattgcaattacagcggcttatatattagcgatggtgctgtattgttttggtatttacacagatattatgtcacgaggattgagctttccctatcaaaagtatattgttcatgcagttattctttacgttattatagttgttctggatattgtatgcataaggcgatattataccagagtttatgataagatgagagtggatataaagcagtacgaacataatttgtatcgtctgggaagatacattcaaaaagaaaaggacagggaatagcttatgatggcacaattagtctattttaaagaatggttaacaactttatataagaggcatgtagagataattttaccgatattgaagttgctttttgctttttttgcactgagtatgtttcagagaatgttttattataatgaatgtattgataaaccatgggtgttcctggcagtttcagctgtgcaggcttttttaccaatatcgtttttgtattatgcgatatctatattgattatgataaatctgtggaatgtttccatggatatttttctgggatttgtaattttctttatcgtctgttcccttgtatttatacgagtagataagaagcatgcgataattattatagctacagtgcttttattttatttaaagctggagtatcttctgccggtacttttagggatgagcgttggttttggagcgattcttccggcagcggcaggaattgtgacgtactttttatcagtatacatgacagatgtaagtacattgcttacgacctccacaagttctagttttggaatgggattacagcgaatagttaatctgattttaattgataagaagctgctggtgcttcttgtaacatttgctttgattatttttataacaacattactttgccacatattttatgaaagagcatggatgtttgctatttttgtgggaaatatagcaatggtactgttattgttatttggaagattgatttttgaactggattatacgatatggcgactgtttcttgaggtaatactggggattggatgttgttatatttatcgattttttagaggaatcggtgatgtgtccagaatcgagaaggtatcctttgaggatgacgaatatttttattatgtaaaagcagttcccaagattaaggttacagagaaaaacaggaatgtaacgaatattaagtccgaagaaaatgaggatgatctcctgtttgatgacataacggaagattccgatttacctgacaaggatgggaaggaagcagagaaagagtgaaagggctagataatagattatgcagttaataagtataggacaatttcacaaagtaatagaaaagtatttatattggctgtctcttccgtcaattggttttacagatattctggagattatcattatcagtgtgatcgtttaccagatgttgaagtgggtacagctaacaagggcatggacgttgtttaagggtattatcatgcttttgctttttgccctttttgcggcaatattccagcttaatacaatatcatggctgctttctaattcgctcagtgttggaattacagcggcgatcattatttttcagccggaacttagacgggcattggaacagttaggacggaagaagatcttcagtaatattttttcattttcagccggagagtatgagggaagacagtctgcgtttacagaaaagacgatcaatgaagttgtacgtgcttcttatgaaatgggtgaagttaaaacaggagctttaattgtcattgagcagaatgtagcacttggggagtatgtgcgtacaggaatctctatagatggtctggtaaccagtcagttgctgatcaatatttttgaacataatacaccacttcatgatggagctgttattatcagagggaatcgtatcgtatcagcgacttgttatcttcctcttacagatagcatggatattggaaaagaactaggaacaagacacagagctgcggtgggaatcagcgaagtctcagatagtctgacgatcattgtttcagaagagactggtgcagtatcacttgcaaaggatggaagattatataaacatttgcagaaggaagaacttgtagaaaagcttcagcagttaaaagttgatgatacaggtaatgcagatgtatttaaaaaatggaaggacttgttgcggaatgaaaagtcagaaaaataatatgtggatgaagatactttctgtcgtcatagcagtcttaatatggctttttgtggcaaatacaaacgatccggtaattacgaagaggttttacagtattcctgtaaaggttacgaatgaggatgcgcttacgaaacgaggatatgcttacgaaattctcgatggtgaagaagtcaatattacagtaaaaggaaagagtagtattgtacgttccatgggaattacagattttcaggcggttgcagatttttcaaagctgtctaaagttgatgcagtaccaattgatgttacggcaaagaagtactccgatcagctggatattacattgggaacaacaaacacgatgaagattaagaaggatgaagtagtgacgatcagtgttccggtcaacattacagtaaaaggagatccagcggaaggatatgctgttggtcgagctacaagtacgccgaatctgatcaaggtaagtggaccagagaatttactttcttctgcgaaagaaattcgtgcaacggtcagtgtagatgatatttctcatgatgttacagcaacagataagccggtgctgtatgatgaagaaggtaagaagatcagcaacaaccagatagaatttgatacatcatccataagtatttatgtggaactgtggaagacaaagacagtagatgtaaagctttcttatacaggggaacctgcaaagaattatcatctggtttcttttgactatgaaccaaagcagatcacaatcgcagcaccggatgatacattagaaagtctggactctattacacttgacagtgtatccattgatggactcaaggaaaattatgagaaggatattgatctgacacaggcagtgcttccggatgatgtgattttagccggagatgatacaaacgatgtgaaagtcaaggcaacgattgaaaagataacttctcatgagttgtcgtttgagaaaaaagatattaatgtaacaaataatagtaatggttacaaagttgtttatgataaggataatgactattcgatcctggtagatggaccatcctctgttgtggatagtctggcgataaaagattttgttccatggatagatgtgaatggtttagaacccggaacacatgaagtatctttgcacgtgagagatgttgagggagttaccgtaggagccacaacaaagctcaagattactttaaaagaaaataagtaactgttcagacttgatcagtagatttatttgtgcggcttctttatagaataccgcacaaatctgattagttacaaatagtggatttgatgaattgaggaaatgattatatgagacaaaaaacagaaacaatgctttgtgctgctttcatggaactactgaaaaagtgtcccttttcaaaaatcacgatacaaaagcttgccggtcaatgtggagtgaaccggcaaactttttattatcattttgacaatatatacgacctgatgtcaaaagcatttgaatatgaactggtacatgagagccgcatatatgaagaagtaacctgggagtatgctatgagcaggttcttacagtggataaaagataatcgcgtgattattcgaaatattttaacaaatgcagaactgccatatttaaaaaaagctatgtatccgctgattgcaaggagcatatcctgtgggtatttttcaaaaaatacagaggcgttttcagagaaaaagcaggaagaattttgtaatgatttctttacattaggaattacacaatatgttcttgaatgggcagaaaatgatttcagagaaccggtagaagatatcatcgcccatctgtcatggcttttacagaaagtgtatgtataaagtgtctgcataggagggtaaaaatgatttccagtacatccaatataaaagtaaaaaatattataaatctgaaaaaaagtgcaaaggcaagaaaaaaagaaaattgttttctggtagaaggtcccagaatgttttttgagattccgagagacagagttgtggaatgctatctcacagaagaatttgccgggaaatacgataaagaactcagaggatggaactacgagcttatcagtgaaaatgtatgcagacatctttctgatacgaaaactccgcagggagtcatcgcagtagtacgaaaagaagaa

SEQ ID NO: 498 - DNA, 5572 bp, Eubacterium hallii
tgtacaggcctgtacgagcatttccccagcagctttttcgtcattataggtaacaccatgtatctccatcaaaaaaggagtgttcaggacggtatctatatgttttatatcggtatcatatgctgtggtgagttcttcatattttgcaatcttttccgggtattccacagcgatcgcatcctgcagtcgaaacaggttgctctcataattggctttcagcatctttaactttgtcacttgtacatctaagtccatcttttctttgatcttagggtttcctgtcgcaagagccttgacctccgcataagataatgctgcttcatcgacatcctggcaggaacgcacaggggatttggatgtcatgatctgcccgatgaacttttgtttattttcgataagctgccaagaatacgcatcaaacgtattttctgtaatatatcgaaatatctttacttttttatttttatttccctgtcttaatatacgtccttcctgctgctcaatgtcagcaggcctccagggtacatctaaatgatggagggcaatcagcctgtcctggacgttagtaccagcacccatttttgacgtggaaccaagtaaaaaacggacctgcccggaacgcactttagagaataatcttgctttttgtacgtccgtattggcatcatgaataaatgcgatctcttcttccgggattccctttttcatcagtttttcttttaaggcatcatatacattaaaggttccgtctttctttggtgtggaagaatcacagaatactaactgtgctgccttctgtccttttgtttcttcccagatcgtaaaacatcgctctgcacaggcagaaaccttattattttctgtatccggcagcatatcattgagaagtctctggtctaaagcaagtttacgtccatccgttgttatctttaacatgttgtcttcacttgggtctactgcaccattccgcaccaactctgctcgttctgccagggactgcaggatctctttctgctcttcacttgccggcaggacaatattttcatattctgcttccgggacaggaagttttaacatatcggcagtttgaatatctgctacttcctgaaaaacagacattaactccggcaagttaaaaaagtttgcaaaacgagttttcatgcgataactgctaccctctggagataactcaagagctgtgattgtctctccaaaagtagaggcccagttatcaaacatccccagttccatttcctgcaggcggtcatactgcaggtatctctgaatagtatacagctctgtcatactatttgagactggagtccctgtcgcaaaagtgatccctttccctcctgtgatctcatccatataccggcatttattgtacatatccatcgctttctgggattctgtttgtgcgacacctgctacatttctcatttttgtatacaaaaaaaggttcttaaatgcgtgcgattcgtccacaaacagcctgtcaatgcccagttcctcaaatgtcaccacatcgtcttttttcttataatttaactttgccagccggacttctaagttctttctgctctttaccatctgcttgattgtataattttctccctgtgcttctttagccaggctgatcgccatctcaatctcatctatctgttcttctaaaatattacgctgccgttctgctgacagtgggatcttttcatattgtgagtggccgataatgacagcatcatagtcccctgttgcgatccttgcacagaactttttacggtttgctggctggaaatctttttttgttgccacaaggatgttggcggcaggatacagggtaaggaattccgcaccccactgttctgttaggtggtttggtacaacaaacagtgatttatgggtaatcccgatgcgttttgcttccattgctgcagcagccatttcaaaggtcttccctgcccccacgcaatgtgcgagtaaggtattgtcaccatataattggtgtgcgacagcatttttctgatgtggctttaaggtgatctccggattcattccggggaattccaaatggcttccgtcatactgtcttggacggatggagttgaatctttcattatagatcgtgaccagcatttcccgccgttccctgtctttgaatatccagtccttaaatttttctttgatcatatcctgcttctgtcctgccagtatcgtttcttttttatttaattccctgtgttcctttccctcactgtcagtataggtatcaaagatctgtatatttttaaggttcagggaattttccagtaaacggtatgcattggctctcttcgtcccataggtattgatcgctaaaatgctcccatctatattttttccctgaatattccattcccctgtgtaagaggaatactgtatctttatcgtatggtttgcggcaatatattttggcggctgaaatgtctctatcataaattgctcataaacttctaatggtatccacatagaacccagccgtacttcgatctctgatgcttctagccgttttggctgcacattttttaatgcctctacattccttttatactctggagcactttccaaaaaattttctgcaatgcgaagtttttcccgtacattgcctgacagatagctgtctgctgtctcccattcctgtgttactggatttctatagataactcctgccagttcttctgttatcttttcccccggctttccacaaagtcccgacataaaggaaaggtcaacttttccatgttctgtcatagacacagcaagggcttcgttcgcagtattgacatgagtgatactttccttttgccggatagtacgtttggagaacatatctgcttttccggcaagatttccgtcttcatctaatctttcaagggaacataacagaggataggaggaatcttccgaaaaagccctcttgttcgctatgctgtttaaaagtccccattcttccgtataagaatcatacagggtattcaattttctctgctctgcctgaatctttgtttctgtattttctgtttcttctacctgcagccggatcagttcccggacacagtcccggatagcagccatcccggtgatacggctttttgttgtctttgtgaccctttgctgctccagtcccgattcatttttataataaatatccccagcttctgatacgacatagctgtatatcctgttctcttccctgtccggcatatctgttacaggttcggtcccgtactgaatttcagcacgttcctccggcatcctttctggtatatgtcctgtgatattggctatggcatcccgtaattgtatttctaaagaaacgccttcgttttctatgcaggcagtctctaccccatacggtcctgagatttctttcattgttcccaggatcatctccgggtgtgctgcaaaataactgtttacagggatcccctgtgcatcctctgtaacagagatccattccggatcagctatttctttttcccttttttgcaggaacaaaatatcagaagttacttttgtccctgcgtttttaaatacagtgtttggcagccggactgctcccagaagttctgccctcttaaaaagatattgccttactttggtattttccttatccatcgtcccttttgttgtgataaatgcagcaacaccacctggacgcagtttatccagtgtctttacaaaaaaatagtcatggatcaaaaatccatgacggttataaacagggtcatttacccggtaatccccaaagggaacatttccgacagctatgtcaaaatatccatctggataatctgtacgttcaaaccccgtattctcaatatttacttctggataaagataaccggctatctttgcactcatctggtctaactccacaccatataacgtagacttgttcatgctttctggaagaagtccgaagaaattccctgtcccacaggatggttctaatatccgtccctttgtaaatcccaggcctgccaatacctgatacacggctttaatgagaaccggctgtgtataatgggcatttaaaacagaccctactgccgaacggtattcttccagagtcaatgccgtctgtatcctctcccttgcttcctgccactgtggtttcttctcatcaaaaacatctgcgatcccgccccatccaacataatctgctagtatgttctgttcctcttttgttgcctgccgttgttccttttctaactgttttaccgtttcgatcgcaaggatattcttccagcatttttcacggattgttcctgttcccagttcttcttttgaaatatgataattctgccccatgttttcagaaacaggagtaaccgctatgttatctgtatctaagatttcttcctgcagttctgctgctgcaatgctgtcttttcttatctctgccgcccaacctatcatctcatcatatcgtatttcccttatctcgtccgaatgatttttaatatagctctttgcttcattttcactatgaaagcgcatcgtttctgaaagatatgtttctaatccattattaccctttcgtaataggcggtaaagaggctgtctatttccatctgcatcaactgctgtaacaaaagaaaccgttgaatcttcataatcctcgctgctttcgacagctacttcaatgagattcgattccttttgttgtttttctatccatgcactggcttcttctctgtttttacagaacttactacgtcctgagaaaataaaatcatcattttctcttgttaattcctgtacatggaacggaaaatctattcttccagtatcagcaatctcatattttttatcctgtaaaacctgcggttcctctttctgcatcaattcatcaagctgtttctgttctgcaggtgttaagcctgtatgttcttcaagatatggcaaaaagttttcactatactttgtaatctgttctatcttttcatccagcacaccatcctgttcccagtattgtctatacatacagtctgaagataaacagtaatcataatattcccggatgtgttctaaaagggatttttcttctgaacctatgtcatatctgcccttgaaagaatattcttctccatctatgaccgcatagatagaaaatgctgtcttataataagaatatccctcttcttcattctcctgtttctccacctcttgttcatccaatactgtaaatagtttatttgctacagcaaaagacattttccgaacagtaaaatcatctttttctttatcataaacacttaacctgtcatgttctgaataatcgatctggaactgcagggtatcctcttttttcttctcctccgtactgaaattcagtacattttctttttcctttgtgtgatcctccttagccgatcgttcctgcatttccttatccttaacataaggatattctttgttttctatcaggatacggatccgtttttctgcttctttccatgtcagtttcttttctgcctttcctttttttaaatgaaatcctttggcatcatgccactcatcagaatgggaa

SEQ ID NO: 499 - DNA, 5202 bp, Eubacterium hallii
ctccattggaggagaaatggttcgtaagatgattaagaaacaggaagaggagatggctggtcagagccgttaagtcttgttgattctttagcgattctttagagaaagtcccttactgaaatcagaataccgtaagaacaagctgcctgtcctttaaaaatataagaacagacggcttgtttctatgtttttctatcagtttttcgtcaaatttttatagacagtgaatatttctcatgttataatatttaaatgtgttttcatatattaaaatacaaagtgagtttactatgaataaactttaaataaggaacatattaaggaggatactaaaaaatgagcgtacaggttgaaaaattagagcataatatggccaagcttactatcgaggtagaggcatctaagtttgatgcagcaatgaagaacgcttacaataagaagaaaggctcttttaatctgccaggtttccgtaaaggaaaagtacctatgtatatcattgaaaaagaatacggagcaggagttttctatgaagatgcagcgaacgaacttatgccagaagcatatgcagaagcattagaagagagcggtcttgatgtagtttcccgtccggaggtagacgtaactcagattggaaaaggacagaacttcattttcacagcagaagtagctttaaagcctgaagttaaattaggtcagtataaaggtttagacgtacagaaggattctgctgatgtaacagatgaagaagtagaagctaaattaaaggaagcacaggaacagaacgccagagagatcactgtagaagacagagcagttcaggatggagatatcattactcttaactatgcaggaactgttgacggtgttgcatttgacggcggtacagcagagaaccagcagttagtgattggttcccatacattcattgacaactttgaagagcagttaatcggtgttgagattaacggtgagaaagatgtagaagttactttcccagaagagtaccatgcagaagacttagctggtaaagctgcagtattccatgtaaaagttcttggaattaaagaaaaacagcttccagcaattgatgatgactttgcacaggatacaacagagtttgatactcttgaagaatacaagaatgatatcaaagaaaagcttgctacagcaaaagaagagcaggcaaaagctgctgcacagaatgctcttatcgaccagatcgtagagtcttctgagatggatatcccagatgctatggtagacttccaggtagaccagatggtagatgagttcaagcagagacttgcttatcagggactttctcttgaacagtacgttcagttctccggacagagcatggatgctttaagagagagcatgaaaggtgatgcgttaaagagagtacagggaagccttgttcttgaagcaatcgttgcagcagagaacatcgaagcagacgaagaagacttaaagaaagagtttgagaagatggctcagatgtatcagatggaagcaagccagattgaaggtatgattccagaagaacagaaagagaacatgaagaaagacatcgcagtccagaaagcagttgaatttgtactggatcaggcaaatgtaacagaagctacggaagagcttgatttcgaagaaaaataatcgtaactataatctggttacagatcattaaaatttctggttgctgtttatgtagaaacaggaggaattatgagtttagtaccttatgtcattgagcagacaagtcatggggagagatcttatgacatctattcccgccttttaaaagagagaattatttttctcggagaagaagttaacgataccacagcgagtctgatcgtatctcagctgcttttcttagagtcagaagaccctgagaaggatatcagcttatacattatgagtccgggtggttctgtaactgctggaatggcgatttatgataccatgcagtttgtaaaatgcgatgtatccactatttgtatgggtatggcagccagtatgggagcattccttctggctggcggcgcaaaaggaaaacgtctggctcttccgaatgctgagattatgatccaccagccatccggcggtgctcagggccaggctacagagattgagattgtagcagaacagattctgcgtacaaaagagaaattaaacagaattctcgcagagaatactggtcagccatacgagaaaatcgtgcaggatacggaaagagataactatatgacggccgaacaggcaaaggcatatggtattattgatgccgtcgttgaaaaaagacagtagtatgtactttcagaatctcaatgtatcagcttttatggtggattttagaagattttgagaacgcatcaaataatagggttaccacagcttttatagttgtggtaacttttctatgagacagattgcagcaggagtgaggtgacaatatggcaacacgatccgacaacaacaagcaattcagatgttcattttgtaataaaacccaggatcaggtaagaaagctcgtagccggtccaaagggtgtttatatctgtgatgagtgtattgaagtatgcatggaaatcatggaagacgagtttgaaggttttaacgaagatacacaggaaatcaatcttatgaagccaaaagaaatgaaggcttttttagatgattatgttatcggtcaggacgaggcaaaaaaggtcttatccgtagcagtatataatcattataaacgtatactggcaggtggaagctatgatgtagaacttcagaagagtaacatcatcatgcttggacctaccggttccggaaagacccttcttgcacagacattggcaagacagttaaatgtaccatttgcaattgcagatgcgacagctcttacagaggcaggttatgtaggtgaggatgtagagaatattcttcttaagttgatccaggctgctgattatgatattgagcgcgcgcagacaggtatcatttatattgatgagattgataagattacgagaaagtcagagaatacttcaattaccagagatgtttccggtgagggagtacagcaggctttattaaagattttagaaggaacggttgcttctgttccgccacagggtggaagaaagcatccacatcaggaattccttcagattgacacaacaaatattttatttatttgtggtggagcttttgacgggcttgaaaagattattgagaaccgtatcggtaagaagtcgattggtttccaggcagagattatggaacagcgcaagaaggatgtaggtgttttattaaaacaggttcttccggaagactttgtgaagtttggattgattccagaattcattggtcgtgttccagttaacgtatccctgaatccattagacaaggaagctcttgtgcgaattcttacagaaccaaagagtgcattagtaaaacagtatcagaagctgtttgagatggacggcgttgaactgaagtttacagaggatgctttagaggcaatcgcagaaaaggctattgcaagaaatacaggagccagaggactgcgttctatcatggaatctgttgtgatggatttaatgtatactattccatcggatgatatggtagcatcctgcacgatcacaaaagagactgtggatggcagcggagaaccggaactggcatatcatgaccagccggtaacgaagaagacggttacaagaaagcgtcaaaagaaaaataatgatgaaatcgcttaacagttactgttaagaggcacaggctgacacaggagggaaatttgttacctttgtgccagcctttttatctcagtcgagaagactcccatttctataagtggtgagtaatcaatacattactcccaaaaaggaggaaaagatgaagaaacagatattacctttacttgctttgcgaggaaagatggtttatccagatacttctgtatattttgaagtatccagaccaaaatcaatggcagctttagagcaggcggtaaatcatgaacaacaaatatttctggtgaatcagatagatccttctattgataaaccagatcaggaagatttatatacagtcggaacgattgcgaagattcttcaaatggtgaaggcaggacagggagttttaagagtatttgtagaagggcagacaagagcacgtatctcttcttatacagaagttgatggatgcgtaaaagtagaagtagaagaactgcctgatacaggctatccggaaacccctgtggaagaggaagcttttttcaggatgcttgaagaaggagcggaagaattttccgagaaaaatccggggttttttgctccacagcttcagaaggctatcgatgaaagagatttacgttcgctagtgaatgaacttgcttctcagcttccatttgaacttggaaaaaagcagcagcttttagaagagtccgatataaaacagcagattcagagtctgcttgctattttgacagaagaagtagaaatcagcatcattcgtaacgaacttgcagaaaaagtaaagaagaatgtagataaaaatcaaaaagattatcttttaagagaacagcagaaggtgatccgggaagagcttggcgaagaagatattgtttcagaggcggatgaatatcttgagaagtgtgaaaagctaaaggcatcaaaagaagtaaaggataagattaaaaaagagataaagcgttataaaaagatgcctccgatcgcagcggaaagcacaatgacaaagaactacattgaaacgatgcttgaaatgccatggaataaagtttctagagacagtaaaagtcttgagaaagcaatggagattttagaagaagatcactatgggcttaaaaaagtgaaggaacgaattcttgattatctggcagtccgtttccttaccaaaaaaggagagacccctattctttgtctcgtaggacctccgggaaccggtaaaacatctatcgcaagatcgattgcaagagcgctgaataaaaagtatgtccgtatttctttaggtggagtgagagatgaagcggaaattcgtggacatagaaagacatatgtaggtgcgatgccgggaagaattgctgaaggaatccgtcaggcaggcgtgaagaatccggtaatgcttttagatgaggtagataaagtaagcagtgattataagggagataccgcatctgcactg

SEQ ID NO: 500 - DNA, 5082 bp, Eubacterium hallii
tttccgacaaatcataagaagaattctacggtccgtattctgaaaacaccgaagacagaaagtagtgtacgtaagatattcttaccgaagagcgttgctaatatgcttgtagactggaaagctgagcaggatgaaatgaaagaaatcctgggtgacgaatatatggactataacctggttatggcaagtacctttggtcttcctcttggtgatggagcaatccgtggccctttaaagaaattgatcgaggactataatctcccaccggttgtatttcacagttttcgtcatagcagtgttacttataagctgaaactgaatggtggagacatcaaggcggtacagggtgattctggccatgctcaggtcaatatggttacagatgtgtactctcatattctggatgatgacagaaggaaaaatgcagagctttttgaagaagcattttatgagaaaaagaatctggatccacagatgcatgtacagcaggaaaataataatactactgttgctgatgaagtcgatccggaacttctggcaaaagtattggcgaatccagagatgcgggcattgctcaattcactggcgaagacgatgaagtaatgaaaaatagtgaaaaaatagtgtaattttagtgaaaaaacgattcataaaacgatataatatatggatgaaatgaggatatttattgtgtatatggatattctatctccatcatttgatgatagaatgacggagataaatctgaaatgaaggagattcctatgagagactttgattttattgtaagtcctgcgaagttgttaacacctgaaattgttcagatggttagcagcatccatgaacataaaggcaaacaggaattatttctcgaagccaatgtagatgaattgaaaacactcttagaagttgcattgattcagagtacgggagcatccaaccgaatcgaaggtatatctactggttatgtccgtgtttaaaaatatgaaagcagcttataaatttgccagtcaaaaacgcatggacaaaccgtctcgtatgcgttatattatttatagacaagaaaatatcttgtacttatgataggaaagtttaattgaatactgtttaccatgatcgaacgtacgaagcatggtggtcatataacagatgtcgatggtaatatcaaggcattccccgattattagctggggcaaacaatcagctaactttcagagctttacagagcttgacagagggggtattcagaataactcgaattgaatcggaaacagttttatatagtgtcccatatgggtttaccttacctcagattgacagagagtgacaataggttggagctctcctaagcgaaacgtcgcaggttcgattcctgtctgggacgccagcaaacaacgctgaaagccttgatttatcgaggttttcagcttcttttgtttttggcttataacctgtcggataagaacatattcaatttatattttgcaatttcttttgattttcagaatttgtaattcgatatttttatgactgtttgagtagaagagtttgctaacactttttttattttgaaaaaatatcagcagatttttgaagatttgctaacacttttgaaaaattactttgaagctgattgtttcaaaagcattgctttcatctctggcgtaagtgattttaaaagctgtaaaagctccatatcactgtctgataagccgttgttttctggctgaacttcctcattttgtggttgcatttctgaatcatggtttagagtggaataaaattgttcgtccatcttttgagcattgtaacgtctatcttcgtctatgatttctgaataaatgtctgtaaccatttctgcttctgcatgacctgtatcgccttgtaccgattttacatcgccgttggtcattttcaatttgtatcctgtggataaatgacgcagactgtggaaaacaactttttcatagccattttgttcgcataacttttgaaatctgtctctcacaattctactttcaacgggatttccattttccaaagctataacaaggttgtaattgttataagcgtctcctagaaattcctgcaattccttttggtctttttgatattgaaccagtaattctgcaaccgtctttggcaaccatacggtacgattacttgtttctgtctttggtgtttttaatacaagccttgtcgtgcaatgtggcttttgtgttggaaaaatcttgataatatctttttcctttaatttctgcatagcttgtgcatttactctggaaagctctttgttgatgattacccttgcgttattcgttgcaatggattgttcatcaataactacatcttcccatgtaagacctgtaatttctccaatacgcattgagcaggaaaatgccaaatgcatacagatggttaataaatcgtcgtctgactgctgaattgcttcacgaaatgtatctacactccatacttttctttttaccttaggaactttaggaagcgttgctaatgaagcagggttacgcttgttggtatcaatatattcccaacggattgcttgatttaatgcacagcgtataatgtcgtgtattttcttgatattggcaggttgtacgcaacgtccagtagcttttctgttagctctgggtacttctggaacactcaataaatcgttgtagtaggcagataatttctttgtggtaatctcatttaacttccaatccccaataagtggattgatgtaattttcgatagtaccgaccttactactaaatgtactaggcgaccattttgacgtaccatagagattgacaaatatttttaagaagtcacgaagcgtaatatcttcatcggtactatcaagttcttttttcgattcatcaatctggcgtgcaaactgttcctctaaaggaacaatcacataaccatatttttcttgataatactcaacaaatgcttttctctgctttgcctctttctttgtctctaacgtatcccatttctgtttacgttctcctgcattgtccaaataccagtaaataacggaaaatgttgattttctttttttgattgaagccataatatattctctccttaacagttaattttgatttaaccatttatcgaaagaatctttagatacccgtatggctctaccagcacgaacataagcgaactgtccacttttaaccaatgcataagccacttttttactcacacataattgttctgcaatttcctctactgtatatgtctttttctcctttttgggagtttctgtatttgatgtatcacttatcacgagtaataataactcctttccgtgtgataacagcaaaatacatacgtttaacaaggtcattatagcataccaataactcttgcggatatgttttttgccgttgctaacacttttgctaatactttttatatgcagacaaatggctttggcaaactccactggtatctcaaccattcccattcctgtgggctgaaccgtgtcatacgggtgtatcattatcctgtgttgcaggtcatggcagaacgacttttccaacggtcgctcccagatcattgcatgaatcgctatctcccgattggaaaagtcacggcgtacaatttctgatggctcactgcaagcacaaacgtatctgtctgcattattcagttgtcaaagaactgttaggctcttgtcagcctgtatcaattcatttttacaaatggactgatacagaatgataagaaaaagcggaacaggaaagaggggagtttgttaaatcatgctccgctcaaatattacttaatgttcgtctatttcaaattcacatatcattttcaaaagggcttctctgatacgtccctttaattccatatcaaccacaatgtatacgttaccgtattcatcataaaatgggcgtaaacaacattttgatatgtaggcttcatagaacagcaacagcttttctatggcgttttcgttaccgtccacggctgatgatatgagaaaaaatgatggaagtgtgtgttgcttattcttcatttgtttttttctcctttaactgctttctgatttcttcaagtgaatttcttctgtacctgaatgatgtgcttcggttgatgttcagcttttcgcctatctccgaatcgctcatatccaagaagaaaaacatcaatacaatgttccggctctgctccggcaactgtttcagtgcttctgcaagttcttcgtcaagtacacggatttctgtaccgcacgtattattgattttattatatcgtgaggaggatatgaaaatgagtgaaaagaatgattttatacaattaccaccaatcaaaaaagacacaccgtccgaagtggtctcaatgatctggcaatatttgaaattacctgagaaatccagaaagagagtgacggcagatctaattgatgtggatgaaaattgtgagaaggaagattttcagattccagatctctatgacatcgttccaaaagaagaaatcgcggaatttgaacaaactatgcgtaaaattatagcaggaattatctctcaggccagcagtgttgccacctgggtgtatgtacagaaatatgtgaagcacaaaactctggatgaaatgctgcaagaatggaaaggggtaagccagtttattattgtcatggatacctggttcgaaagattgatggcagaataatagatgctgtgatagaatgaagaaaacgatttgaagtgcaaatcggaagttggaggatacacgcatgaaaattgtaatcattaatggaagtgccagaaaaggaaatacgctggcagcaatcaatgcatttataaaaggagcgtcagaaaagaatgaaattgaaatcattgaacccgacaaactcaacattgcaccatgcaagggatgtggtgtctgtcaatgctctaagggatgtgtcgataaggatgatacaaattctacaattaataaaattgctgccgcagatatgattctttttgctacaccagtttattggtggggaatgtcagcacaattgaaacttatcattgataagtgctactgccgtggattgcagttaaaaaa

SEQ ID NO: 501 - DNA, 4994 bp, Eubacterium hallii
aaagttaaagatgcaataaaacgtaccgcgacacctgctatttatatgattaatcccgatatacgtacaaaaggcaaagtatcaccagatttaatagacatattttataaatatgccaatataccacgcagtagatttactgatacaatacaaccagatgaaaaacacgaaattattactatatatcccaatctatttggtgatgataaaaaaattaaaattggtaatataaccactattgatacaacagataaagtacaaaaaaaagagagttgtcagccccttggaaaagctaacaacccaaaaacttttaaacaatctacatttgacattaataatatcataagcgatgaaataatgcaagaaatggacaaagtgttcaaacaatgaaaaatatacaaatcccaaaagaattatttttagatttatgccgacatcaccttgcaggtatccgctcgcccgaacaggatcagcggatacagcaaggactgcaaaacaaattggatgcagttaaaagacggtctgactatcagaaacagagggttactcatgataaaaaagatatttagagcaatcaaaaatatactatttcctagggtttatgccccatgggaacaacctggtatcactgatttatcttctgctgaactgcaagaattaatagctttaattgatgcatatttggcagaattagaggaggatgaataacaatgattgaaacagcatatccgcacgaaatacctaaacttacagccgaagaacaaaaagatttatgtaccattacagacttactggcaaaacataaaaataaaaattttagagatgctgtagcgcatgacatgtatatgtataatgaccttgatgccatgataattggagcattaaaagcagtaatctttgacagctaccagtataacgaacaaatggcacaagaaattaatgacctcgcatacgaatgtgcaaatcatactctcgtagagtatacatattatgacttgcttgaaatcagcgagaaggattggacaaaataatatgacaatatacgacttatttatctggatatacgacaaattaatacacaatacgacacgatggtatacctctgatggcaaaatcagaggagcatatattaaccatatcggtatgggattggcagaagatttttctacctgcaccccggagattatagcggaactagagcaaatggttgacaatcgccgaaaagaattacatcataacttataagttatgataaccccggaaatcaacgtatttctgaggttttttcattgtcaaaagtctttatcaaaatttatattttgttctaatcatttcataacaaaaaatacaggaaatcataacatttacagtgctgttgagaggggcaggctgtggctaccccgaagaacagcgcaacccgaagggaaacacaccgcacaacggcgtgtaaatgcctgcggcgcattcatcaaggcaggattgttttctttgttctgcagaacccctcaaaaaaagaatccgattccataaacctagatttgcataactatataaattcataaatgtttatttttaaagaatccgattccattagagcaagccaatacctacaagttcatgattgcattatcggcattgcgccgcaggcggctacctacagctttctaggcactatagggtagccaataaccccaatctatatttctgccttgatgaatgtgcgccgcaggcattacacgccgttgtgcggtgtgtcgtatcttctggggaaaaagaattcgattccataaaataaaaatttctgctatttgttgttgcaatctatcatactagagatgtacttagttagagacgtttggaggcttaagaataacagttcttccagtcgaaaaagttttttttctgagtcgcacatattgtagttgtataaattcaaatcgtaaggaggaactggagaaagtcctaagattgtagcgtccaccagatgggcgaagtcttaggcatttgtcagcggttccgcctgcacccaacttgcagaattttattctacagaagcaggtgttagctttcggagatgttgctttcggaagtcgagtaaaatcgggtagccaagacggttactcgtatttttttgtcagaaaatgtacgagtaaacggggattggcggtatttatccaaaattgcaatggtactatctagttgatttagatgaaaaacattaaggtgagatagtatctgtaacctataaatttaagccggacagggttgttactcctcgtaaatgtaaccaacagccacgagttgttaaatagagcttgatattatgtatcaaggcgtgggtatgcttagctttaacagttactcgttaattaatattagatttttaataaataaagggggtgttattatgtcgcatcagaacaaaaaatcattgatcgggcaggcagatgcccgcctgcagaagatgacactggcaggtgttggacgctctaaacaccaagataagatagatgatatagaccataaatatatttatacttgggagacgtatcggacgtacatcaaacattgctgttatttcgttaactggtgtaaagaaaatcatggttgtaagacgctgaagcaatgtcggcagtacgtcccggagtggatagcaagccgtcgtgttttgtctgccagtacacaaaaactggatgtggctgcattgtctaaattatattgctgtcaccatggcagaggacagaagcccttccgggacgttgagacagacacacgcagccgggcagatataaagcgtagccggggcgatgccgtccgggataaacattttagtcggcgaaataatgcggatttaatcacattttgtagatgtaccggcttaagacgtgcagagttgcaagatttacgttttgaggattttcggattggtgccccggatagtagcgaaggtccgggattatatgtgcatcgtagcacgaaaggcggcagagtacgccggattaattttgtcggtagccaagccgagattgccctgtgttgcaatattatgtctaagggtagtggcttaagcaaagtgtggggtaaagtacattctgcggctgatatacactctttccgggcagattatgctactaaggtgtatcagatgtatgccagaccaatcgaaactctaaaacatgatgagatatattactgccggggtgaccgcaagggcacctggctcgacaaaaatgctatgcttatagcatctaaagcccttgggcacaatcgtatatcaattattgcatcaaattacttgagattatagggaaaaataccacttttggtatataccataattggtactctaccaaaagtggtatataccaaaagtggtatccatgtaccataattggtattttaatcatttctcatataccaaaattggtattttacccaaattggtatataccatttctggtatgtgtgtaccaaaactggtattttgcatataccaattttggtacacgaggggttttaggggtatcccctaacaagatttgcagtttgtacacacaaaatgcgtatcttgcaataagcctgacggcttatatatcccgtatttgggatataactccctaaaatgggatatgtctaattcccatatttgggatatggttccctaaagtgggatataataaaatcccgtttccgggatatgattcccagaaatgggatatagtaaaatccctagtatgggatacatttcccagaagtgggatacaactccctaaagtgggatttacaaaatccctaatttgggatactatttttatagaaattaatgtaaatcattacatattaaggtgtttttaatatattaaaaatccattagtaatgtactatacagtacactgaatatatttttacggtcaaaaatgtccattaaaaagacagaccctttagggtcgtggtaatggatatttttgtgtgcgtagcacgtaccgaaaaccccactctattttttttacggtcaaaaatgtccataaaaactttcaaatcattattttttatggacacttcaatggggtttacggacaaaaatgtccattaaaaaaatgtaatatcctttatttatgcggttttcacgatggactacttatgactatctgatttatatctgactatcatctaaatttacttgacactatatatatctaatagtataatacaagtgtgccaaaaatatgtgccaaatggcataaaaaaataaagaaaggagaatccaatgcaatggctaaagaaattactatagatggagtgcgttatgtattagtaccagctcccggcagaccaacaaaagatataaatttagatagcatatataataaatatacggccggagcaactgccaagcaattagcagcagaatatggtgtatctgtacgtacaatatggcgaagattagcattggcgaagtcacagcatgagaaatcccaagaatccacataatagtacgatagtacagggattacaggaactatctaaactggaaatagataatacaatgcgaacacaaatacaggatataatacaatatctatctaaacaccctagtatggcaaaagatgttgatacaactgtgcgatataaacaatatccagataaacagataacattcaataaatcaccaacatataatagtattggtaaattacatcaattattagataatggtagttataatttattatcatatctatgtgattatatgtcagttgataattgtgtctacatcaatatattgtctatatctaccgacttacatatatccgataaatctgttcgccgacatgtaacagttcttatcaataatcactgtatcgtaaaagttaaagatgcaataaaacgtaccgcgacacctgctatttatatgattaatcccgatatacgtacaaaaggcaaagtatcaccagatttaatagacatattttataaatatgccaatataccac

SEQ ID NO: 502 - DNA, 4918 bp, Eubacterium hallii
agtccaatacctacatttacggttgtggtggtcttgccgactccacctttctggtttactacggatataactttacacatgatttcttcctcctttaactttcccatgattcttttttccataatttcagcagtgccagtatttcccgtttcatcattgccggtgtataggaatttggaaaatacttgtgtaactgctcgtttgtgaatgccactcttgtgatctcaccctttttaacttcacacatgatttcttccatcttttccagcgataattgtttttctttactcagctgctttatccgctgagcctgtgagagtgacggaatcgcctgtgcataatccattgctttaagcagttctctttgttcattttctttcagtgctgctatttccacagccgggcaaaaagaaataatttcatcatccagcttctgcaacatttctggtatcagctttgtcagtgaaatataacgctgcacttgttttgggctatcaccacaatcctcactgataatatctatcgaacgttttcttgtttttttgtggtcaacttggctcttttttcgaccactttttcttttcaatacgtcattctttaatttgtaagcaaaagccttttcactgtagctgatccgttctctatgaagattcgaatccaccatgcttaagatggaatcatcttcacttaatacccggatgatcaccggtactttacggtatccaagtttctctgcagcatgttttcttctgtgaccggatatgatttcatagtagccatccggtaccggtctgacgatcagcggatttaagattccatatttctcaatgctttcctgcagaagaaacatttccttatcatctttcacctgaaacggatgctccttaaaagggcggagacgttcaatctcaatttctatgattctttcttctttttctcctgattgtctgtttgcatcagtcatcttgactcctttcctccaggattcaggaaataaaaaatgcctgcctggaacttttgttgtaagaaaagttccaaacagacattgccgtttgactattagctgtagctaatagaattgaatactgtttcagctaatttatgtttgcaggtttcggagagattgtttcttttcctgccttttctctgatttacatccccaaataaggggtgacaacagagcggaacccaaatgttagctggactcttgaaaaaccatgtttgcaaaccggtgattttgattagctgtcagctaacaaaaatcggattgtgttagctggaaatgaatcattttgaatggaatttcatgccacgaacgtgattagaaaataagaaaagcgttcgctgtcagctaatccagctaacattttcgaacgctttgaagcccgtcgccaagaggatttgaacctccgacccctcgcttaggagagctccaacctattgtcactctctgtcaatctgaggtaaggtaaacccaagtgggatactatataaaactgtttccgattcaattcgagttattctgaataccccctctgtcaagctctgtaaagctctgaaagttagctgattgtttgctccagctaataattggggaatgccttgatattgccatcgacatctgttatatgaccaccatgcttcgtacgttcgatcatggtaaacagtattcaattaaacttcctatcgaaagcacaagatattttcttgtctataaataatataacgcatacgagacggtttgtccatgcgtttttgactggaaaattttatattttattacgatatttttttcaaaatctttttctcatttgtctttgaaaaatcacttaaccgataagatcggactcgtgtctttacaatgattggaattaacaaaccattatttaccagctttgcacatcgattaataatcgttttgttggttacatcaagcattttgcttacttcaattggtgtaaactcatataatcgcttttttaacagaaatgctaagaattctttttcttttgcatttaaataagatagacttccatctaactcgtcgttttcggatgtttttgataattcatatacctttttagaatacaattccatcatccgcaaaaaataattgatccatatttccggatgaggagggttttctcttcctgaataatataacgccggtaaccccatttgcagtgatgcataatactcatctggatcataggcaaaatattcttccagagaacctattccattaaaaccatatccataataatcaagaatatagcctgacattaatctggcggttcttccatttccatcttcaaaaggatgaatggtaaccaattgataatgaactacagcagcaataatcagcggatgatcatctgtagtatttacatattcaacaagttcatccaacaagtctggaatatcaatatactctggtggaatatattccgctgcgcctgtttcggaatcatatactgcaaataacattccaggtggcatagggcctcttaagcctatcttttcttttgacgcacctttttcaaccattgcctgcacttctaaaatcatttcttttgaaaaaacttctttctttttcagtttttcttctaaaaaatttaaagctaaaaagtaattacgaacttcctgttctggctttaaaaaatgtttgtgaggatcactatcaatagcctcatttgcctgtttttcagttaatggatttccttcaatcttattagaagcataggaactttttttcttagagttttttctaagtctgttttttataacaggtggcatttctatcgtactaagagaaaaacgcttttcgtctatttccgatattctttttaaaatttcatttgttagcgtaaccttaatcacatgatccacctccatttcatccatatattatatcgttttatgaatcgtttttccactaaaattacactattttttcactatttttcattacttcatcgtcttcgccagtgaattgagcaacgcccgcatctctggattagccaacacttttaccagaagttccggatcgacttcatcagcaacagtagtattattattttcctgctgtacatgcatctgtggatccagattctttttctcataaaacgcttcttcaaaaagctctgcatttttccttcggtcatcatccagaatatgagagtacacatccgtaaccatattgacctgagcatgaccggaatcaccctgtaccgctttgatgtctccaccattcaatttcagcttataagtaacgctgctatgacggaaactgtgaaatacaaccggtgggagattatagtcctcgatcagttttttaaaggaccacggattgctccatctccgagaggaagaccaaaggtacttgccataaccaggttatagtccatatattcatcaccaagaatttctttcatttcatcttgctcaactttccagtctaccaacatattagcaacactcttcggtaagaatattttacgcacactgctttctgtcttcggtgttttcagaatacggaccgtagaattcttcttatgatttgttgggaataccaacaacacatcttttccatccaatgcattcaacgattcttttcttatacgctgtgattctttgttgatgaagacatatgcacggttttcttcaattgcctcagaagaaatatctacacaatcccaggtaagaccaagcagctcaccaagtcgcagggaacatgagaaagatagattaattgcgagctttaatcgttcatcttcacagacactgagcgcatacatcaatgtatccgctgtccagatgtctcttttttgtgatttatgttttggtacagtcgcatgagtacagggattcttttccatcagttcccatttcactgcctgttcaaaacagttcctgagcagcttattaacatccctgaccgtactggacgatacaaattcatttcgactggttttatttaatggattgataacgacacgcctcttcaaaagactctgataatatctttcgatgaatctggtattgatctctgagagtttcgtatcaccaatgatcggaagaatatagttattgataagagagacatttccttcatatgtagaaagcgcccagttttctttgccataaagtgcaacatattctgtaataagctcatccagtgttttgcatttccggacgacaaatgatcccatctcttttttatattcaatttctttttttcttctctttgcttcggctttcgtttcataggtttcccatttctgttttctctgacatttctttatcctcttttccttgaaatatgaaagaaaaattattccttcatataacgaaacgctcagagcatgttttacagtggtcaaaagcaaatttttttactttttttcttacgagttttcttgcgagtttttttaatgcaattcgcaagaaactcgtaacattagatttttacatttttcatgaaattaagtaaagaaaaagagcatatggaattgaatccatacactctatgattactggaactttatttcatttttaattcaacaaactggaatttggtgtgtgctttataaattttttccgatccactcaagttcgttcatggaatccttatttttttcaagttcatctctggctgttgcgtaatatgattttttgaaaagcatatcccatgaaagatattttgccatacagtcaaactgcttatcaatcagctcatactggatactgcctacgggagaaccacctacaacaattgtgccaacttttttgttttttaactgcaatccacggcagtagcacttatcaatgataagtttcaattgtgctgacattccccaccaataaactggtgtagcaaaaagaatcatatctgcggcagcaattttattaattgtag

SEQ ID NO: 503 - DNA, 4062 bp, Eubacterium hallii
atcagttgttgctcatccctgccgagataagcccgacgcttttagcatcacatggccataagtctatgaagtattaccctcatagcgtgatgtttgtgcgtcaacgtgtcgcaccaaagatattttcaatctccctgctggcaagaagatccttaatgttctgagtgataccagtcggtacacctccccatttacggaatctcttccagatttctacggaataagctgctgtctgttcttctttgagcagaaggtgaaactcatcgatatagtacctggtagatttgatgccacggttgattgtaactctgttccatacctgatcctggacgatgagcattccgatttttttcagctgttttccaagctccttgatgtcaaagcagacaatacggttattcagttccacattggttctatggttgaatactttcagtgatccatttacatagatttccagtgctgttgcaattctctgggcctgtggttctttctgctttctgaggcagtcatataggtcaccgaggaccggcatgttttccggttttggatctgcaaagtacttctgatacaccagtggaagacagcggtcgatcactgatttttcctctgcttcaataccgtccctgcttcccatgatcagctcacataaggacaggacaaaatcagatttcacaccaagtggattgtcatcatcggaataatccatattgatatccattggattgatatagtccttactggtaggtgagatatgaacgacctgtcctcccagtgcgtggaccagcggataatattcaccttccggatctccgatgataatgtcatccttcgtaacaaagaaagcattggtgatctctcttttggcagcaaaggatttaccggatccaggagtaccaaggatcaggccattcggatttttcagtttcttgcggtccaccatgatcatgttgttgctgagtgcatttaatccgtaatacagggattctcctgccataaaaagttcctgggtggtaaacggtacgaagatagcagtgctggtcgtggtcagtgcacgtttgatggggatatgattgactcccagcggaacactgctcatcagtccttcttcctgctgatagtccagacgtttcagtacacaattgtatttctgtgcaattccggcagtctggaagatggcattgtccagtgcctgtttggtctttgctgtatttaaaaagagcgctgttacaaggaacatacgctcatttcgtgactgcaggtcttctaacagacgcttagcttctccgccatacgtgttcagatccgatggaatgatatccatatcgtatccggcccggactgcttttttctgttcttcgattttcatacggttgatatccgtcactttgctttttaccagcttgattgccttcatctgatctactgactgcacatgcaggttgacgatcaggttcttatcgatatccagaaattctgccagcatcttatccgtaagctccggtgccaggatctgcagataagagacagccccgatagtatttcccatctggaacgtatttctgtctcggaatacaaaactggtcggtgccacataatcctttgtattgagtcctgtccggatcatggatccatagtcaaactgaaaatctgtcatcacatccggattgaatgtctcatacagtatctgcagacgttccacgccattcagcggatatgccggaactcccaggatcttaaagttattcaggatatccgactcgatacgttccagctttggttttgcctcccggatattttctgcttcaatggcaaatgtgatatattttgacttcaccagaccgttgtttccttttgccagctgctgtttcaacatctttgcgtattccatacggacatcatcaaaagcatcctcctgtggtcggatccggatgacctgctcaaactccttcatgctgctcttatggttgataaagctcagctgaaaatggatactggcatcaaagtaattgaggaaatcacaccagttttcaaagattgcatttttatcttcgttctgagccagctggtagttgatgtcatagaagcggatgcacttagaatacgtttttccctgtaccctgcagattccatctcttcccatttccttataagcgatcgactgctgaacagacagttttttctgcctgcgtttttcctcctgcttttcctttttctttttctcttttctgtctacttttttgtatccggtatctgcgacagttttcttatttttcttttttcgcaaccgtttttcctcctttcagttttcctgtatccggagactgcttgatctgttccggatctgtctcataatagttttcagtttcatattttctaacgggtggacgaagaaacttcacccggatcatatgcatcagaacatcttccagatgcatcccgtctttttcgtacatggcaaataaaaatgccggtaacatcaaaagtaccatgaccgttgctgcattactatttcccatcacattacgcaagaggaaatagcttggaattcccattgcagcacctataccgatacagatcagctgtcttttggtcaggttaaatgctactttattctttaccttcgttaaatctttcggtacgctgacatatgccatgattttcactccttcctgtaatttagtgcgcgttgaatatcgacttacttaaagaggccgtcttaaagaggctgtaacataagatcactgtgtaagccataacgccaaataatgaagaactcagattatctgaatactggatacctgcaacaagcactgcatagattgcaacgcataccatcatcagaaatgcctggaaagccagggcaaagagtcctctgaaataattcgtgccgatctgtccccattctctgttactcatagttgcaaatggaatcggcgcaactgaggtatataggtaaatctctatcatacgtccatacatgatcactgtgatcagtacagacaggattctcatacagaagccggcgataagggtttccagcgccaatacaacaagttctccgatttccatactttccagggttgtggaaagatccgtcaatgccgaagaaatatcaatggcggtacttcctgtgataacaccggccgcagaattaactacgtgctggcccacgtcgaataccgccattgtgatcgtaaaggtgttactcaccagataaacagcaatccacatttttacgaagtacttgaaaaacatccaggtatcaatatcatgcatgttgttgcgctcggtcagcatagaaatcaattcgtagcagagtacgagtgtgataataatacctgcgatcggcatgatcacggaatccgataagttccggatcatactgaatatgctgccgttccacccttgcggggtctgtccaacctgggtagcgatctcaccagtcttttgattgacatcagtaaacatcgtgtccaggttggaagtgatcatcccggttaagagttccctcatccattcctcaatcgcatcaaaaatctgactgaacatggatctctactcctttctcttaaccaaataatccactcagaagcgggatcagctgtgttccgatcaggataacaccaccaccgctcatcagctgttttatccccaattaggtgtaaaactctgctcgatggcgggcggcggcgtacaaaaaatctatatggtgtttttaagagaaccgtcccggcgggacaggtcaggcagtgacctgttccacctccgggatgggtttgagattaaaatgaatttcgatagaaatgtgtcttgttttatcctcgtcaatgcgctcatgcacgacgatttctttgattaagcggttgagggtggctacgtccagctctgtgatgttggcgtattcctgaatggcttccacccattgttttgcgtcattggcaagctggacttcatcggacagccgctttctgccctcggacacttttgttttaagctccgtctgctcggtctgtgtcttttccagcatggtgttgaaattctgctcactgatacgccctg

SEQ ID NO: 504 - DNA, 3855 bp, Eubacterium hallii
tttttgatttgaaccttgggaaacctgttttcggctgtttgaaaaagttctgaaatgccgtatcaagatgcctgagtgattgttgtaatgcgatactatctgcttcctttaaaaatctgtattcttccattttcttcattgcagccatttcttttgcacaaatggtatatgttacgttggtcttgttctcctcatactgccggatctttctatcaagccaatgattgtataccattctcacacagccaaaagtcttagcaaacaaaattttctgttcatcattgggatatattctgaatttatatgctctgtttgccaccatgccacttccttttcctcgaaaatccacctgcgatacttgaacacaagcgcaagatgctagtatagtaagagtactaaatgtgcgttattatctaaatttattgtattttaatttttattatttgactaaagatattatactatgattagaacgctctatcaagtaggtaagagacgcaattcatctcccaccttagaggtcggagtcttcttactgtaaaaggataaaaatctcgatttgttgaactaagtataccataaacttttatcctaagaaatgttctaactgcccttttgcaggcaaaataaaagaacttgaacaccttaattttaaaggttttcaagctcctaaagtacaggagatgagagaatcgaaccctgtgggaactcctcacaatccccgtaaaataagcatttcttcgattgagttttgactacatttgactaccttttgacaacatgggtggtaaaaaaacaagaaaggagaaatcgttcagcatggtgtcatctttttcatgtatcacttcatatctcctctaaaatacattatcgtctggataatgtgtcataatatttgcaatattgcattccaatattgctcctagttcaccaattcataattcattttcacagaaatttttcttcaaacctcatcactattttgctatactataaatatgtaaattagcagtataaaaggagaattaaaatgttcggaataaataaagaagaaaagaaattaaaaaaagaattaaaactcgaaaaaacattaactagtattagcggattaacaagacttccagatgaaacacacgaagaattcgtcgcaagagtcaacgaaaaatgtaagacaacgcaaaaagaaaattcaaaaggtgctcaagaaatgtatcaatactgcattgacaacaactttggaatgggattaagtaaaaattggagcattaaacattttttattaattcaaaaagcattacaaaatgatgaacgagttttaatgtcttttattggattacataattataaatcagcatcaaaacatgacaataactttgcatatgctatcactaataagcgtttgattctctcacaacaacaagcgttaggtgaagttgttcaatctatcaatcttgataacattaatgatgtaaccaaaagttccggtatactttctggaacaattacattcgatactatcaaagaagtatttaatgtaaatgtttcatcaagtgcagccactgctattacaaataaaatacacgaaatattatattcacagaacacttctgctgaaaatcattctccatcttctgcttatagtcctgctgatgagattttaaagtataaaaatttattagatataggtgccataacagaaaaagaatataaccaaaaaaaacaagaattattacagaagtgatttagaatttactttcattatatatgtctaaaaagcggttggtcataggaacgcaactgtttttttctattttgattggataaataaatttaatagtgattttaatgttacaatgtttatataactacgaaaggaaaatttctcaaattatattatggcaaaagacaaaaattacaaaggtatggtgtcagaagttgaccctatagcaataaggaaattatattatgaatatcgcatgactaatcaagaaatatccaacatgacatgggaaacgaaagcaaatataaataaaatcttaaatcaaggaattaagtattataatccatggatagaacaccatttaactgaacaattacatcaagtctttgaggacatgttgaaaaagcatatatttaacgaaacttccgatgacctttctacatgctatttaataaaaaataattcaactggaaaaatatgttttatatggtatgatgctgattctgtacattgtttatttgacgaagacatatctcttgatttaaagactttagctcacagtgaacatatggatatatataatgaacttgattataaggtacttgaaatcagtgagactgatagtatcttaaaagaaccgcacattgcgttaactcaaatttcaaaaaaattatttaccaaagcatctcgtgtccgaaaaatgtcttcagcagaatatgctaattttttaggatttaagggatatttaacagaacgagataccaacagagattcaaaaataatcaattttttggaagaacatataatagatggactggtatatttaagttcatcacccgaaaatcagtggattcgtaattatgcctcacgttgcggaatgtcattggaagattttcttgattattatggatataaaaaatcaaaatacgattataattatgtttctcaacgaaaaaacgaaaaatataaaaacgaattaaaaaagtacattgtagaaaatcccaatactgtatatatatcatctcaagagccaatatatcaaactctgtataatatagcacaacaaaataatatgactttagatgactatatacaattattaggttatacacgttctaaaggacggaatagtttaattgaattgtctggagaaataaataaaattcttagtgttgaaaacgagaaaattgaaaaaaagatttcttcaaatgaaaaaataaagagaaatcatctattaataaataggcttaaagaattttattcatatgaatgtcaactttgtacagaaaatcaaaaaatgaccattcaaaaaaaagatggaacaaaatatgtcgaagtacaccacatcaaaaatctttcggaggaatatgatgaagaaggaactttagaccgtttaaataatttgattgttgtttgtcctaatcatcacaaaatgcttcattatcataacggtggatatcgaaaaatagtaaaaactaataacggtttagcttttacaaacgattcttcagacattattcctattgtacataataaacatttgacaagcaatgaataattacaattaatattattccaacacctattgatgtcaaggaacaaggcgtagccgatacgccgtcagggcagtccttgacagaacggacgttatattatttcagcaataaaacaacgaaaaataaggaaaaacagattgaaaatgctatctcattttaggaatgattcctgtttgactagatacttgactacattggaattatccagaaaatgaaaaaagccagaagccttgaaaattcaaggtttctgacctcttagtcaacaggggatgagagaatcgaactcccaccaaaggttttggagacccctatcataccatttgaccaatcccctatatttaattttaaggtatgtaccttcaaaactacacacaaatcaacttttttctatttccaataactttctaaggtcaagctttcgaccgattagtaacagtcaactccacacatcgctgtgcttccatctctgccctatctacctcatcgtctctaaggggtctctcactctttcgagtctggatatctcatcttgaggggggcttcacgcttagatgccttcagcgtttatcccttcccgtc

SEQ ID NO: 505 - DNA, 3479 bp, Eubacterium hallii
attttgaaacaagcgttgcacgagatatgagagatcgtctgggtcttgatatcagagaagtagaagatgaagtcttccgctctgagaattctgttgtgtttgatgaagcagagaacagaatgcattcaattaaggctgtgatggtggcaactctcggaagatagtttacctggaaagacggtttgatatcaatgaaagaaaagattttagagtttttgaaacagcaggatgggtttatatccggtcagcgtatctgtgatgagctgggcgtttcaaggactgctgtttggaagtatatgaacagtctgaaaaaagagggatatgagatagagtcggtgacccggaaaggttaccgacttttacaaagcccggatctgctcacaacagaagagatactttcttctatgaaagaagcttatataccgggagagttatgttgttttgagagtattgattctaccaatgaagaagcaaagcgccggggagaaagcggtgcaccggacggaagtgtctatgtggcagaccagcagactcacggaaagggacgaagaggaagaacctggatatctccgtcaggagaagatgttttctttaccatactgctgcggcctgaactgccgttagactgtgtttccatgcttactttagtagcggcatctgcagttgcggaaggaattgataaggtgaccggacagtgctgccagattaaatggccgaatgatattgttcttaataagaaaaaggtatgtggtattctcacagaaatgaatatggagattgacagcattgcatatgttgttgttggtattgggattaatgtaaatcgtataaattttggagaagagattgcagatatggcaacttcacttaaaaaggaaagtggtcataatatagaaagatctgtattgctttcagaaattctgacagcttttttcagagattataaactgtttttggagaaacaggacttatccccgtttttagattattataacaagaagcttgtgaatgtagaccatgaagtaaagattataaaaaaagatgaggaaatcattcgtacagcgcttggtattaatgaacgaggagaactgatcgttcaggatgcagagggaagaaaagaacatattttttccggtgaggtatccgttcgtggtatttatgggtatgtataggagagcgttagtatgtttgatgataaagtaatattatgtggttccagcagttatgagaagattttttactttaatccggaatttgattcacttcctaagcagattaaagaggaacttcagattatgtgcgttctttttacagaagatgtgggaggaattctcagactggaatttgatgaaacaggaaatcttaatcttactgtggagtcaaaggaagatgatttcttctttgacgaaataggaagtgttcttaagataaaacagctacgtgcagaaaagagagaactcctcgaaaatatggaaacatatttcagggtatttttcttacaggagggacaagatgttactggcaattgatattggaaatacagattttacgataggaatctttcaggagaaaaagctgtgcgatacctttcgaatgagaacaaagattaatcgtacttcagatgaatatggtgtatttattttaaatactcttcagtataaaggatatgaggcaaaagatgtggaagatgtcattatctcctctgttgtaccggcagttatgcattcttttaacagtgcgatcatcaaatattttggtctcaagccgattatcgtaggccctggaatccgtaccggaatccgtattgcaacaacaaatccaaaagaaacaggggcggatcgaattgtggatgctgtagcaggttatgaactttatggtggcccggttatcgttgttgactttggtacggcaacaacgtatgacttgattacacaagatggcagatttgttggaggagtgacatcccctggaatccgtacttctgcgaatgctctctggcagcaggcagcgaaacttccagaaattgaaatcagaaagccaaagaatattcttgcaaaagataccgtaacaagcatgcagggtggtcttgtttatggatatatcggtcagacagaatacattatccgtaagatgaaggaagaaagcggtcttggaaagatcaacgttgtagcaacaggcggtcttggtaaaatgattgcaaaggaaacaagttttattaattactatgatgccaatcttacattgaagggactgcagattatttatgataagcagaaacaggattaaatcatgactgtaaaagaaatatatggcacagattttccagtgattctggctcctatggcgggaattacagatcttcctttccgaattttgtgtaaagaacagggtgcggatgtgatggttacggagatgatcagcgcgaaggcacttttttatgggaataagaacacattgccgcttatgcagacagaagaagaagagaaaccgatcggagtgcagatttttggctcagagccggaacttatgggtgcaatggctcataaaatcgaaaataagggattttcttatattgatattaatatgggatgccccgttcccaagattgtgaacaataaagaaggctcagcattaatgctcaatccggaacttgccggaagaattgtaaaagaagtttctaaagcagtaagtttaccagttacagtaaagtttagaaaaggttttgatgatgaccatatcaatgctcctgaatttgcacagatcatggaggaaaatggtgctgctgccgttgctgttcatgggaggacgagagtccagtattataccggagaggcagactggaatattatcaaagaagttaaaaaagctgtttctattcctgttatcggaaatggtgatatttttaccggagaagatgctgtcagaatgcgggaatatacaggttgtgacggaattatggttgccagaggagcaaaaggaaatccatggctctttcgagagataaaggcagcactttttggagagaagattccagaacgccctacagaagaagaagtgatttccatgctccttcgtcatgcacaattaagtgtgaagtataaaggagagaaaatgggaatccgggagatgcggaaacacacagcgtggtatactacaggaatgcatggttcttcctctcttcgaaataaagtaaaccaggtagaaactttagaagcgctcagagaacttttgatgcgttgacaatgaattttttttggactataatgatactttaagtgaaccagaaaagaaaggtgtagattatggtggaagcaaagaaacatatcctgacaagtaagggaatgcaggcattagaagatgaactgcaggatctcaaagtagttaaacgaaaagaaatcgcacagaagataaaagaagccagagaacagggtgacttatctgagaatgcagagtatgatgcagctaaagatgagcagcgt

SEQ ID NO: 506 - DNA, 2851 bp, Eubacterium hallii
ccacatccacagccctcttcatgactatgctcgtgatcatgatgttcatgatgatggtcgtggccacatccacagccctcttcatgactatgctcgtgatcatgatgttcatgatgatggtcatgaccacatccacagccttcttcatggccatgctcgtgatcatgatgttcatgatgatggtcatgaccacatccacagccttcttcatggccatgctcgtggtgctcatggtgatgctctgctgttttgcgcttaccgcgagttctttctacaacctcaacatctggttccatagactgaattgtctctctgatttttggcaaaactgcctctgggtcttctgcttcaaatcgaagctgctttgttgcaaatgtaactgatacatcgtttaactctggcagcttgcttaactttctttcaatcttggctgtacagttcgcacaatcaagattctccagaatatatacctttctctgcattgtgatacctctcttctcgatatcaggaatcggtatgtgtcatatgaatcaatgcctcttccataatatctacaatatgctggtcatccagtgaataaaaaacattcttcccttctcttcttgcccgcacctgatgcatcttacgcatcacagcaagctgatgagaaactgcagacttagtcatgtcaaggaaaacggcaatatcaccggcacacatctcctgttcttttaatgcgtacaaaatccgtatccttgtatcatctgctaaaaccttaaaaaaagatactaccttatcaagttcggtctccttaggcatactcttttgtactttctcaatactttcaggaaacattgccacacaatcgctctttttcgttcccataacttcctccttcatcaaacagataattgaatatccgttcaactgttatcattatagttgaacaggtactcaattgtcaataggtattttttaattttacacttttctaaagctgatatatctttattacaaaattttaatcacattccctgtacaattaaaaataaattttttcccaaatgcattttttataatttctaaattttcatctccagtacaatgcgaaactgcaataaactctatattgatttcttttagcgccgctattgtctttttaagccggctctcatctgcttctactaaatgcgttccgccaacaataccacaaatcttttttttacttcttttttgaatcgtataaattatattcataattccaggatgcgaacagcctgtaattacaacaattccgtcttttatctcaagagctgctgcaatctcatccgtaaaattatcttttttatatacgcctttctcttttacaaaaaaatgaggatttccctgctcatagtctgtaatacgttcaaaatttcgatgaatcgttattcccggaaaaatttcccgactatcttcttctatttcacagatttttactccatacctttccacatcgttcctggaaaatgaaattcctatattttttattgttccatcttttttctcatgatatttttcctgaaaaaaactcttccccacatacattttttctatcggaatattttccaataatctttccacaccacccacatggtcatagtgtgcatgactaagcaatagcgcatccagcttatctaaagaaacacccattttttctgcattatcaaaaaatgccccgctttgtcctgtatccatcaatagccgaatcggtggtttggaatccaatttttcaattaaaatagaaaagccatgctcacatacatatttttcttctgtatcttcatgattttcaatcaatgttgttaatttccattccataaaaacgcctccatctcttataaaatatgatacaataaattcatagttttgagaagtttaaaaaataaactggatttaaatagttaatatgtcatgacaggaggcttttatcatgaaacattctcttcacttatacggaacactcggtcctgcctgcgcttcaaaagaaaaaatacaggcaatgtttttagcggggatgaccggaatgcggctcaatctttctcacagtaatcttgatgactgcgaagactggctacagcagtatcacgaagtttccgaacgtatgcatatcattccggaacttctggttgatctccagggtccggaacttcgtataggaacattagatactcctctatcactttcttctggagatatcgttttccttatatcagaaaagtccttccaggaaaaaaaagaaaattcagatattttttcccgtattcttaatggcaaagatgaattttttattatcccatgtccggaaattctcttctcttattttgatgaagagcaggaagtccgccttaatgatggaaaaattgttttaaaaatatccgctcctctagaatcagatattttttgcgcagaagtaatcaagggcggcgaattaacttccagaaaaagtatcgcaatcaaagatcttactgttccactccctgttcttacaaaaaccgacaaggaaaatcttaaactacttcggaaataccacgttaccggtgtcatgcttccttttgtaagaaacgcagatgatctgatcacactccgaaaagaactgatggcagataatatggactatattcgcatctttgccaagatagaatccatagaaggtgttgaacacttgccttctcttcttcctttctgcgacgagattgtaattgcacgaggcgatcttggaaatgctattccactgccaaaacttcctgctgtgcaaaaaaggatctccacaacgtgcctccatgcaaaaaaaccttttatggtcgtcacacagatgctcgcctccatggaa

SEQ ID NO: 507 - DNA, 2831 bp, Eubacterium hallii
tccaatctccgactgagataaacgctccgcgaggatgcgcagtgattctgtaaagaatatgtcagcttacgctgaccagaatcacgcgccaagtctcgcggcggctcgacttgaatataagttagtataaattatcttttatacgttcagactaatattactatctttatactattttatgttagttttaacttactcaaatgtcaatacttttttctaaacttctccctttattcaaacaactttttatcccttaaaaaacaaaaacctgaaaatcatagtatacaaaactatacggcagggaaccgatgaatgtgataaaacattcttcataaagctctgtcatacagttttatatattataattttcaggttttctattatttatctgtttttcaatctacgagagaaaatccctttctttatttgttaagcaaacaaaaatcaaagattcttcaatacttccattactccattttcatcgtttgtcttttctgttacatactttgccaatgatttcaaagtcggatgtccattcttcatacagtaactttcaccacagctttctaacaaagacatatcgtttaaataatcaccaaatgccattgcctcttcatgtgcgatactatatttttcacaaattgcttttactgcatttccttttccttctgtcttgtttgcaatgtctatccagcttgcaccggataaaaccgtattcagatttttaccgacattttcaaaatatttcatggattcttctgctttttctttcttaaaataaacagctacttttacgattgcatcatttttcacagcttcccttaagtccttcacgattgttttacgctcataatacatttctacgttataacgtatctcctcgtctggttctgtgacatatgctgacttcgccccacagacaactgctgttgcataaggaactttttcaatcagatcaatacagtttaatacatcctgcttatccatttcatctttaaaaatgacctcacctttttcaaatacaaggccaccattttccgcaataaaagtaagcttgtctctgatttccataaagtctttttctaaagtgtaatactgtcgtccactggcaatcactacttttatctccggatgcttttctacccatggaataaattctgccggtttttcctttttactgttaagtaatgttccatccatgtccagtgcaactaattttatgttcattctgttctccttaaatcaaaccatgttctatacaataataataaattccctcttccgtaacatccccgcaaatgacatctgccgctgccttcacatcttctgtcgcattgcccatcgcaacaccaatccctgctgtctgcaacatttcgatatcgtttgaaccatcaccaaatgcaatcgcattctcttttttcaagtgataatattctaaaactttttctacgccaacgcctttatttccttttgccggtgtaatatctgctgctcgtggccaccaggcagtaattcttgcaccatctacatcttttaacagtgcttcatactcttccttaccacagccaaccatgagctgatataccttcccattcatgattttttcaaaatcatccgctacctttaccctttgctttccgatagcaaagtaatccgccaagtctttatcacagccgttcgcagcacatccttctacgtttgcaacagaaatcggacgattaattgcggcagcatttgcaacaattttcctcacatcttcaattaatatgggattttcaaaaataacttcatcttttgtataacaataagatgcgttaaaagctaaaaagacatcaaaatcaattcccggaaaagtcggaaccatatatggacctcgtcctgtcgcaatacataaaataattccattctttttcaatcgctttaatgtctctatcatcttaggagaaattatcttcttctccatgtcaactaaagttccatccacatcaaaaaaggctatttttatatcttttgcagcatcttttttcatatatttctcctggtatattcttctgattttttacacaacactcctattattttacagctttttgttttcctgtcaagtagaaattatcctatgagtaatttccgcaactctctcctcttctctatgtccagttttaaaaaaatgcgtgtaatcacatttttgatatatccataggaataattcatctgctcggcaatctccttattttccattccctgtgcaacagccagggcaactttccattcaactggtgttagtttttcctgtattctctttctgttttcctgaatttgcgtatctataacagtctttcgtgaattttgcgcacttcttgcaagatgcatctctactctcgcaagaagaacctctttggcaaaaggcttcacaatatagtctgttgcccctgcttttaacccttttacttcataatccgattctgaaaatcctgtaagaaaaataaccggtacttcttcacatcctggaattccttttatcttttctaacgtcatatatccatccatttccggcatagcaatatcaagcaatatcagattgggaataatccccttttttaataacgcaattccctgctttcctccttttgccacactgacactgtataaatcagaaagtatttcttcggcagtttttaataaaataatatcatcgtctataatcaatatgctttttttaatcatagcctttctcccattcttccataagctgttccgcttcatcaaactctaaattccgaacggatttctgtatcttttccaattgttttctttggtctgcatccttt

SEQ ID NO: 508 - DNA, 2447 bp, Eubacterium hallii
gtgatgacagtgaatctcatgtgtacttgagaattcttcaccggtaacagcacattttccccattgagcagagaatagtgatattctgttatctgcatattccgcgctatagccatagggtggcttccgcataagcgagagcagaatggccatattgattcgtaggttattgtgaatgccttcccgcccctctggagtgtagtaattccatgtttttttacggaataaaggattcttgtgttgcgtgtagccaataggatatactggctcatttgtgcctgcaacatatcgcatcattttggattttccaaatcggcttctttcaaactcagtcaattcccgtccggttttaaccaatcgattcccgttacgggtactaagcctatttgtgagcagtgtcataactgcacgatttagtattgcgcaatcatggttgatatgggtggcaatgcagtaataattctgcattcctgtgaccatactgttatagagcctgatttcaccctgttctccatagatttttcggggatggacaatccgttttgcctgtgttttcagcttctggcgcttgtggtcaaaattcttatcagcgatgtatgaaattaccaccagcttgttgcctttcctgtgaactttcatcttgaacccaaggaagtctgagtaatgatttctgacattgataatccttgttttcttttctgagatttccagtttcagcctttctcttaaccactgtataactgcgtgcattgtccgttcagcagtatctttcgttctacagtaaatccgaaagtcgtccgcatatcgaacaatgaacatctctttgaggttggactttttcgcctgtctgtacccgttttcaggtctgacatttcttttgcatatcggactccattgccattggctttcaacccagtggtcgagttcgttaagaacgatgtttgcaaggagtggagaaatgattccaccctgtggtgttcccttatcaggcgtaataaatgttccgtcctcaagttttatctgtgctgtcagtattctccgaagcacaaatataagcgccttatcgtgaatccccattgcccaaatctgccgaatcagctttgcatggttcacattgtcaaaaaatcctttaatatcgaattcaatgacatagtgcaggtttgcttgctgtaacagtttataacttctggcaatagcgttttctacggaatggttcggtctaaagccatagctgttctcactgaacttagcttcacataccggctccattacctgcttaatacattgttggattaacctgtcccagatgcatggaatgcctaagggtcttgtcttgctcgggtcgtatggcttcggtatctcctttcgcctgactggcttaggacgataaccatgctcacttccgtttacaataaatctcactttttcaactacttcatcaggggagcactttccaatgtccctgattgtgagtttatctgttccacacgttttacttcctgtgtttttcttgatatttctgtatgccagcagaatgttttccctttgaaggacgatagacatgaggtctgtaaacacctcaccattcttactggcagcatatagattatcgaaggtatcttgcattccgtaatactcgttatgtcgcagattttcctcacatagcagttgtttcttttttctggtcataaggcatcactctcctttcgcgggaaagtgtccctttttgtcttactcgtaatccttatacgattgaatgacaacaatagtttctaaccgactaaagcccattcctcaagcccgcctttttcgttgggctgtcataggttcgagcttcgcttttcagcacagattaagcggcttatatgattcgtccgcagattgcttatgagcaactctgtacctttccacgttccgataaccctatctgtacatatatccttaggtgtccgctatagtcctgtcagcttgattgtgcctgtaacacaatacggaatttcatattttcgatttttactttaccgcactgacccacatttaagtgtccgtacatttctatacggtaaacatctagacccgtacattcgcggttttcgtcagtccgtcgtagacattctcaccatagatattttatagactcccggcgtgtcatctgcatacagtacctctactgcactttcgtcagccgtgttgccacgctgttacgacaaacttccgccgactttatcgagctccagactccagccattacagccgaagccggtcgaagtatcagagtaggcatttcagggcgttactccttcattctacctatcgggttatcagttgttgctcatccctgccgagataagcccgacgcttttagcatcacatggccataagtctatgaagtattaccctcatagcgtgatgtttgtgcgtcaacgtgtcgcaccaaagatattttc

SEQ ID NO: 509 - DNA, 2414 bp, Eubacterium hallii
ttcatttcagtataactaagattagtattattagggtttgaaatgtaaacttcttgaagtttgttttcgggacttctagaagtttgattttgggacttcatgaagtttaaattgtaaacttctgcaggctcttcattttccacagaagtttgttttttaaacttctctaattcctctccaaattttttcgcatctgttttctcaggcataaaggtttttacgtagataacattcacctttccaaatccctgcctgcgtttctcaatcagaccaattcctgtttcgtcatccagctctctcatggatttgatggctttatttctgccacagttcagtaattccatgatatcttcgatggaaaagtagatatatgctctgtttttgtcgtcaaaccactgatttttgatggaaagagacattcgatccaacatcagtccatataaaattttagcatcgcttgataaatctttaaaatagctgtctgtaaataatgcttttggtatgcggtagaagctgaactgatcagcttcggtaccgtaaaaataattaaatgtcatttttttctccataatttcctcctttcattttctgctaagaagtcctctttttaaacttctttgacattgttttcttagctttttctctccttaacaggactgttcctgcatccacttttctaataatgattcaatcacctgctccatatctttggctgtataatcatccggaaaatactttgtcagtttcttttctgagaaagtaagagaccgggatactttctttgccatcacacagttattgaaaatcgataacatctgaatctgattgattggtccatcattcagctgatttctgagtgctgcaatctgttttggtttgatgaatccggtgtcgctgatatattcgtagatccatccctgtacttccttatcgatgtaggagatatcaatagcaactgtaaattggagctttttcttatctaccagatctaaaagttctggtattaattccgtaagacgaatatatctttgaacctgtcgtccactttctccattatcctttccaatgagatctgccgtctcataattcccgacattttgtcggggattttctttggtcggacgacctgctgttcttctcatagcatccattttcatcttatatgcaaatgctttctcactcggtaacagttcctctcgctgaatgttagcgtccaccatcgcaatcacggcatcatcatccgataattctcttacgattgccggaatagtcgtaagtcctgcaagctgtgctgcatgcattcttctatgaccggataccatttcatattcttcattatcatccattcgaagcagtaccggtgtcagtactccattgatccttacactttcaaccagatcctgcatcttttcatcatccagcaccttgaacggatgatttttaaacggatggatcttactgatttctatctccattgcagattcttcatttaccacacccagcagttcatcaatgcttgccagtttaatcttttcgccacttctatttttcatttttcaaaacctcctgtgttaagttcttatatgcttcggcaacttttcctttcgggcagtgcatgtagatgctttttccctctgcactggtctcagcagcttttacagacatcgggatcacattttcaaatacctcgatctgacttccgtaggttgtatgtactctcgatgcaatatcccttgcgtaattggttctgaaatctaccatggtcaggagaatgccctcaatcgccagtttccggttcagtcttttctttactgtaagaatggtcttgatcaactgttgaagtcctttaacaggcagatatgcggcctgcacaggtatcagaacagaatcagaagagaccagtgcattgatcgtcatcataccaagactcggcatacagtcgatcaggatataatcgtatcgtgatcttatcgcatcgatatattccttcatgatcatttctctgctcataacatttcccatcgttacttccaatgcagaaagctcaatatttgccggaagtagatctacattttcctggtgatgtaagataccatcttccagattgatttcttcttcgttgatgacatccatcatgatcgttgccagtgtgattcgaagatcatccggttcctcatatccgagacttgcagttaaacttccctgtggatccgcatcgattagcaacactttcttgccttctcttgccagtccaatacctacatttacagttgtggtagtcttgccaactccacctttctggtttactacggatataactttacacatgatttcttcctcctttaactttcccatgattcttttttccataattttagcagtgccagtatttcccgtttcatcattgccggtgt

SEQ ID NO: 510 - DNA, 2298 bp, Eubacterium hallii
agtcctcattccagaggtcatccgggatatttccatcttcgttcaggtctttctccgttgtttcttttatctctgcagtatttaagataacatcttctgatgtcgctttttcatccacagtgacagcgaacgaaagggtctgtgtacttccggcacgaagggtatcaatgacataggtaacatactgctttccattgatttccataaccttaccattgtttgaagcagaaccctctacataagtactaagctctggaacagcatcccttacaaggacgttcttcagtatcgtttcagaatcattgtgaacatcaatatagtagatgatctgtccaccctgtttcacaactgttcccgatgccgggtttgaggtttttcttgcagagatattctgcgttacctttgtgactggcacatcgagttcaatctctgcatacgcattgtctgcctttgcttttacgatattcgtgatagaatctttgttaagatcagaaagaacttccgcatcataggtaacttccagcttatcttttactgtaagattctttcccgtttcaatcgtaaaggaagtatcatcggattttacagaaacaggtgtaaactcatttccgttatagtaaactttaatcgtatcccctttgatcttttctttctcagagtcttcatcttttaaagcatccttaatcactacatttactgcagttctgtcttcccttgtctgtgtgactgtcagatgatattttgcagtctcacctttctgataggaatccttgtcactttctttttccactttgataacaggagtttttaagtaaacaatctcatcatcttttacttcgtctgtattagagccttttgcagtcgcaacattcacaaactgatttgtgtcagcaggctctttatttatttttgcttcataagttactgtaaacttcgtatgtgtgatcggtgcatcccactcttcctgagtcaagccttccttgttcttccagtggactttatcatcaatctctgctaacttcttaaatggagattctccgtcataacgtaagttcattcctgttgtgatcttaaaggaagtatcatcctgtgtctcaagatatggtttctcagcatctttgccagcttttttaccaaggtcatatactgcccctgtctcatcctttaatcggatagtgccttcaacgatagtctcacccggagtctgtaactggtcagtgatgacaatatctcttgctaatgtaccttcatgtacatttgtaacaacgagagtatattttactgtctccccaaccttgtattctttcttttctacggactttttaatgttcagatgaggggtgttcacccatacacgttccagatcgtctggaggggtatccttgtcctttaacattaaagtagcagtaacaaatgcccggttttcaatcacttccccgttcacacaagtaagtttcttatctgcatttgctttttccagacagtctgcccactggtctgtgatggaatcgtaggtagatttttcttttgctgtacaagtcagtttgattgttgcaacttctccacggtacagtttcgggatagtgataacaaatcctttctctgtatattctatctttgcatctttactgatgtccctatcctctggcgcaccagatttttctttatcaaaagtgctgctgatcgtaatggaatctttatccgggagcattgcttttggcaggctttcatctgtgataactacgttatctgcgatactgttgctatttgcatcaccaacattgatcgtataatctactttgtcaccaacctgccattcatacttgctgctttcctttttaatagtagggtcggctgtctctacggctgtctgtactttatctgtactgcggtctttcacacctgtctgtccctcatatttaatctgggaatcaatatgtgtttttgcctgattcaagaacgcatagacatactcgttatctttactctttactaagtcagtaaagccagataacttctgtaagtcagatactttctgtaagtgtgccagcttcttgccatccatctcaaggtgtccaagattttcatcttttaaagtttctgcatcggctgaaatctttacagggaaggaaaccacgatcttattaccagcatttccaccgtagaattcttctgaagttaacacgtcagcttttgctgtaagggtaatgctgttatcttccccttttgtcacgtcaaatttatcggtataatccttgtcccctgctttgattgcaatgtcttttacatcataagaaa

SEQ ID NO: 511 - DNA, 2288 bp, Eubacterium hallii
agaaaacttaattgtttttcggcttcttcctgcgtgatctccaatacggataaaaggtcacggacagtaaccggggcaagttccgccatctgtaagataatctcctcaatacggtcattgctctcctgctgctcctgtctctgcttctgttttttcttttctgcttctttcgctttctcatggaaattggtattgataagcggatacagttcattttcttttgagatttttgcatcaaagaggacaacctttttgccccataccatgactccctttcctacctcctcagaattcagtgcattaaattctgtctgggataattcctggatctgggcaagggcattcgcatctgcacctccctggtcaaggaaacacttatagttgcagttgctgaacagttcttttaacattttgttttctaaggcggcagtgatattctgcattgccatcgtacagatgccgccatactttctaaaggttgcaaccgccgtattgagctgttcggcagaagtacctttcctgctgacaacctgcgtttcatccacaataaagtgggttgccctctgtgcctcctgattgtattccatgcgggtagaggtataatgcataactgttaccataaccggctcccagttgtccggcggtacatttttaagtccaaatccaatcatacggttatccagacgtactgtggatggataagccagcatatcacagcttccttctgtatattcttcaagggaattatagattggctttatgattgatctatcataatcatcttttgcattctctaattccagttttatctcttccctcaacatacgtaaggttgcctgtttctttaatcttttctgtgcaaagattttatcaaacatctttcttgttgccctgctgactacggtagcgtgttcctgtgtaaacaggatatttgtcatgatagctgccacaaggctttttgcatactttgtctgcgtagcgataaatttttcttttgtgtctttgtccgcataaaataccgcatcggacacctcaaatccattgatatatatctttgattttggggtcaggtcaaaataagaacctccgtatttttctacgatctctttaaactcgttctgagggtctaagattaaaatatcgtccgacgtggagataagtgtctggaatatctctgttgccttgataagcaccgacttaccagaacccgtgtgtccaacaatgattgcatgagggttcatcagcagtttcctgtttccgaatatcaatcgttttgtcgtgaggttcaacccataaaaatatccgcctgggtctaaaatatcctgggcaaagtatggctgcatcgcaaccatggaggaagataggaagaaacgcatgtagtctacctgccgtccggcaaaaggtaatgctgtattcaacgcttttaactgggtatagtctgctgtacttatgactactccctgtgccttgcctgtctcttttaactgctcgactcgctgtgcgagggttgtttcatctgctgccgttgccacgaacaggaaattcaagaaaaaacctgtctcatcattgtcatttactaaatccatgtatccttctatctcatctttttttctctgctttgcgtaagaaggtcctgatacaatgatattctttttcctttttgcttcttcctcctcactgatggatttttcattgttcatcgctgcagcaaccagtttttcattgataacatccgcagggacaggggaaaaatccaacgtgataaacgatggaaaatccacataggaaaaactccgcatcagctcatccggctttaatgccctgctgtatttccatccgaacagtacggaaacatactgcgttttatcaaatatcataaaattggaatactgcttgattgtctgtggcatcacatcatttttccagtcatgctttcctgtctcatcaagatagatatactgttcttcgtcctttttacccggacggagtaatgcgtgcaggcattttaaccgttcttcaccgtttaaaaggagtatctttccacgccactttgcaaacatctgctgtatcgttgtatccagcgcattgagcaggatagtcgcttcctccaatgaatttgcccggcaggaaacggtaagataacggagtgtcgttacatttggattggaattctccagtttttcccttgtccattcttttatccctttatcaatctgcgggtaagccttgctgttctgctttccccgtatcttttctaaaaattcgtcaatactctgaaattcgtttgc

SEQ ID NO: 512 - DNA, 2168 bp, Eubacterium hallii
ccaaaacacagaaaaaagaaataataccatatcccagatgcggcttcggagcgtgtttaagatgcggttgagcatcttaaacacagcgactacagagcagatgggatatggtattatttcttttttcgtttgttttctctaatgaatcaaatagtaaactaccttctttttcctgtggaatgtcttattattaattgcggttcatattctaagcgcatgatcggacgcttcttttcttttttatcgtctttttgttccatgcgggttctctgatttctaagcatagataccgcataggctcctttttctccaatacaatgatcaatcgttgtaagagaaattcctgagaaagaagctacaagtgtgttatcaaatccacatacggaaaagtcttctggtatgcggtaaccgaggcttgtgattgcatccataattccaattgccacaaagtcgttcgtcccaacaaaggctgtgatattctccagttctgcatttgtttcttctttcttttttaagatatcttctctttttttgaaatattttcttgtcaggccatatccggtgtcataatgcttatttcctgtaatcgtttcctgttcttctctttttcctgaaatgacatggataaaagaagaatccagtccctgtctctcatactcttcctgcattccttctaaacgcctgcgtctcggcacttctatggacgatagcggggtggtcatgtaaccgatgtcacgatgaccgagttctaaaagatgtgctgcaatcagccggccagactttttactgtcaagttctagtaattccatctttaaatctggattgtggtcattgatcaggactaatggaagcttttcatataaatgatttaaagaagataccgctcttggcgcatacgtgtagataatcccataaaatccggtatctgatgccatattaaggtaatattcttccctttcttttgaacgattcgtataggctatcagcgtatacaacccatgttcctgtgcttcctgcgtaataaactgaatcaatgttgtataatactgtgttgccagagaaggacacatgatcataatcgtatcgtttgtccctgtctttttctttttggctcttcctctgtattcataccccatttcttttgccgttcgttttacccgttcgattgtctctggggcaaaatgaatatcttcccgaccgcttaatatcatcgaaactgctgactgagatacaaagcatgcttttgcaatatctcttgttgtagtacgtttctttccgttcattctacatttcctctaaaatttattttaattaaaccaaattgactttctaccctgtatttctcttcatactgcacattactaatcatttttgaaaaattaatcagaatcgcacttctctcctgttttcttcttgattagtaatcaaactgactggtttgcacctattttttcatacatttttactaatcattttcttgattaattgtactatgattttgattagtaatcaacagtttccacctgtattgacggatgattttttgtgagtatactgtgatatatcaaaacaacagcacagcatttacccgtcattttaatcacccaatcacataatagacaggtaaaagaacactggcagacagcaatagtactcttggaatctttttgtgcttgttttcgttagaagattttttgtcagttgtacccaatttttgaggcgtacgcggtgcgtacgttgatgaaattcgggtgcgactggtggaaaatcagccacaaaagcaagtgcaagaaagactccgagagtacatcaataactatggaggtatttatcatgacaaagaaacttaatctgaacgactacttaggacacaacatgaattgcacttgtggagaagaacataaaacaaatcttaaaattgtagacattgacaaaaatgccgtagcccgccttccaaagcatatcgaaacacttggatataaaaatcctttccttgttgctgacgtaaatacgtggaatgccgccggcacacaagttacaaaagaattagagactgctaatatttcctataaaaaatatattttcaaggacaaagaacttgttcctgacgaaaaaacactcggttctttaatgatggcattcccaagagactgtgatgttatcatcgc

SEQ ID NO: 513 - DNA, 1904 bp, Eubacterium hallii
tagctgtctgtaaataatgcttttggtatgcggtagaagctgaactgatcagcttcggtaccgtaaaaataattaaatgtcatttttttctccataatttcctcctttcgttttctgctaagaagtcctctttttaaacttctttgactttgttttcttagctttttctatccttaacaggactgttcctgcatccatttttctaataatgattcaattacctgttccatatctttggctgtataatcatccggaaaatactttgtcagtttcttttctgagaaagtaagagaccgggatactttctttgccattacacaattattgaaaatcgataacatctggatctgattgattggtccatcattcagctgatttctaagtgctgcaatctgttttggtttgataaatcctgtgtcgcagatatattcgtaaatccatccctgtacttccttatcgatgtaagagatatctacagcaaccgtgaactgaagctttttgttatctaccagatcaagaagttccggaataagctctgtcagtcggatataacgagtcacctgcacactgcttattccaacttgctcacccaataattctcgtgactttttacctgacttgtgttcattttgtacacaagttaaatcggttctgattccctgtcttttcattgcatcaagtttcatcttgtaggcaaaggctttctcactcggtaacagttcctctcgctgaatgttagcgtccaccatcgccacaatggcatcatcatctgataattctcttacgattgccggaatagttgtgagtcctgcaagctgtgctgcatgcattcttctgtgaccggataccatttcgtaatcttcgttttcatccatacggagaagtaccggtgtcaacactccattgatctttacgctctctaccagatcctgcatcttttcatcatccaacaccttgaatggatgattcttaaacggatggatcttactgatctctatctccattgcagattcttcatttaccacaccgagcagttcatcaatacttgccagcttaatcttttcaccacttctatttttcattcttcaaaacctcctgtgttaaattcatatatgcctcagcaacttttcccttcgggcagtacatgtagatactttttccttccgcactggtctcagcagcttttacagacatcgggatcacattttcaaatacctcaatctgacttccgtaggttgtatgtactcttgatgcaatgtcccttgcgtaattggttctgaaatctaccatagtcaggagaataccctcaatcgccagtttccgattcaatcttttctttactgtaagaatggtcttaatcagctgttgaagtcctttaacaggcagatatgcggcctgtacaggtatcagcacggaatcggaagaaaccagtgcattgattgtcatcataccaagacttggcatacagtcgatcaggatataatcgtatcgggatcttatcgcatcgatatattctttcatgatcatttctctgctcataacatttcccatcgttacttccagtgcggaaagctcaatatttgctggaagcagatctacattttcctgatgatgtaagataccatcttccagattaatatcttcttcattgataacatccatcatcattgttgccagtgtaattcgaagatcatccggttcttcatatccaagacttgctgttaaactcccctgcggatctgcatcaatcaacagtacttttttaccttctcttgccagtccaatacctacatttacggttgtggtggtcttgccgactccacctttctggtttactacggatataactttacacatgatttcttcctcctttaactttcccatgattcttttttccataattt

SEQ ID NO: 514 - DNA, 1800 bp, Eubacterium hallii
tttcttatgatgtaaaagacattgcaatcaaagcaggggacaaggattataccgataaatttgacgtgacaaaaggggaagataacagcattacccttacagcaaaagctgacgtgttaacttcagatgaattctacggtggaaatgctggtaataagattgttgtttccttccctgtaaagatctcagccgatgcagaaactttaaaagatgaaaatcttggacaccttgaaatagatggtaagaagttggcacatctgcagaaagtatctgacctgcagaaattatctggctttactgacttagtaaagagtaaagataacgagtatgtctatgcgttcttgaatcaggcaaaaacacatattgactcccagattaaatatgagggacagacaggtgtgaaagaccgcagtacagataaagtgcagacagcagtagaaacagccgacccaacgatcaagaaagaaagcagcaagtatgaatggcaggttggtgataaagtagattatacaatcaatgtcggtgatgcaaacagcaacagtatcgcagataatgttgtcgttaccgatgaaagccttccgaaggcaatgctcccggataaagattctatcaccatcagcagcacttttgataaagaaaaatccggggcaccagaggatagggacatcagtaaggatgcgaagattgaatatacagaaaaaggatttgttatcacaatcccgaaactgtaccgtggagaagctgcaacaatcaaactgacctgtacagcaaaagaaaagtctacatatgattcgattacggatcagtggtctgactgccttgaaaaagcaaatgaggataagaaacttacttgtgtgaacggggaagtgattgaaaaccgggcatttgttactgctactttaatgttaaaggacaaggatacccctccagatgatctggaacgtgtatgggtgaacactcctcatctgaacattaaaaagtccgtagaaaagaaagagtacaatgtaggggagacagtgaaatataccctcgttgttacaaatgtacatgaaggtactctggcaagagacattgtgatcactgaccagttacagactccgggtgagacaatcgttgaaggtaccatccgtttgaaggatgagacaggtgccgtatatgaccttggtaaaaaagctggaaaagatgctgagaaaccttatcttgagacacaggatgatacttcctttaagatcacaacaggaatgaacttacgttatgacggagaatctccatttaagaagttagcagagattgatgataaagtccactggaagaacaaggaaggcttgactcaggaagagtgggatgcaccaatcacacatacgaagtttacagtaacttatgaagcaaaaataaataaagagcctgctgacacaaatcagtttgtaaatgttgcgactgcaaaaggctctaatacagacgaagtaaaagatgatgagattgtttacttaaaaactcctgttatcaaagtggaaaaagaaagtgataaggattcttaccagaaaggtgagactgcaaaatatcatctgacagtcacacagacaagggaagacagaactgcagtaaatgtagtgatcaaggatgctttaaaagatgaagactctgagaaagaaaaaatcaaaggggatacgatcaaagtttactataacggaaatgagtttacacctgtttctgtaaaatccgatgatacttcctttacgattgaaacgggaaagaatcttacagtaaaagataagctggaagttacctatgatgcggaag

SEQ ID NO: 515 - DNA, 1782 bp, Eubacterium hallii
ccaaaagttctggcaaacaaaatcttctgttcatcattgggatacattctgaatttatatgctctgtttgccattccaacacttccttttcctcgaaaaaccgcctgcgatacttgaacacaagcacaagatgatagtatagtaagagtactaaatgtgcgttattatctcaatttattgtatctcaattttttattatccgactaaagatactatactataattaggatgctctatcaagtaggtagcagacgcaattcatctcccaccttagaggtcggagtcttcttgctagaaaaggataaattcagaagaaccgttgagaatcattatcttgtttatccctctgtcaaatgaaaacttccgaaatccgattcctgtttttcgactaataaagtagaacatctgaaccaataccgtcaatagctgtacaattaatgatgctacagcacttccctgaattccacatctcataatatctacaaaaaagaaatcgagaactccattcaagatacatcctgcaagactgacaatcatacaaatctgcggtttgccatcaacacgaataaatattccaaagattgttccaattaccataagtggatacgtaaacagcatgattctataatactcagtaaagaaaactgacaaattaccgtctgctcttaaaatcttcaagattggtgtaaaaagcaaaaatactataactctaaatcagctatatattaagaggttttcttttttccatagaaaaaaggctccgaagacctcataatcactagaaaataaagtgtttataaaactttcggagcctccacatattctgtatataacaaacattcctattttttagcgtgcgtcaggaagtttctgttcttttacagcatttccgctcacatagtaaaataggcagctatttcttcttagctacctacccgccaatggaatatttggattcgggcatgacccacgccttcctacggtctatgattagattagcacataagaattaaatcatcaactgcctttttcaaaaaaatcacagatatatactattactttctttttttcttaaaatcggcttatatataggagcaaacattcttagagcaaatttcgcaatggcagacaaaaaccctccgggattttgtctgacttgcaacttgatggggattacgactctacgttccactccggtcggtgctaaactatgttttcaggacagccccttgatattttacatttttttcaatctgtcgtataatatatgttctgatccatcaataagatttctttttttcttatataagagagtccatgaagcttgattctttgtataatccattttttcttcaggaaaaaaagaacggcaaaaataactatcatctcttgcattagataaaaacaaaaatatattttttccttccatatgatttttcatcagataatccgcttctatcacagaatagacattcgcttttttattatacttaaaaaccgtatcattactatcaagcattttctcaagcagcggaagaaaatgcactctgtcttgtattttatgatagaaatccgaagactctatattttccctttttataataccgttctgaatttcatcaaatatttttcttctatcacgtcttaactctggtctgtccgtaagatattgtaatcccatcaaatgaaaacagtccttcttatcaaacgttattataagtttaaccgcaacattttttcttcccagaacaatttcatactccgttgataagagaggaataa

SEQ ID NO: 516 - DNA, 1511 bp, Eubacterium hallii
ggtaacgaagatgaaatggcaagactttgtggattgcgctaacgaataatgcacatcttttagtagaaaaacgtcttatttctcagcattctttaaaatgattaacattttggaatgctgagtataaagcttcaaatgttaatgtttccatttgaagcagaaagcgtagcctatactgtctgccaacattacggacttgatacgtctgattattcctttggatatgtcgccggttggagcagcgggcgggaacttgcggagctgaaaggctctcttgaaacaatcagaagcaccgctgccgagataatcaacagtatagatgaacatatcgcacaaattcaaaaggagcaggacaaggaacaggcagcccccgcacaggagcagccggaacaggaagccccacaggacaaagacaccttttccatttttcagataaaaggcggggacgaaacaagggacttgcgctttgaaccttacgaccgtctgactgccacaggacaccgggtagacccgaaaaactatgcccttgtctattccgcagagcttacgccggggacttcccttgaagatatttacacccgctttaatatcgaccacccgaaagattttaagggacatagcctttccgtttccgacgtggtggtgcttcatcagaacggacaagacaccgcccactatgtagacagcttgggttataaggacgtgccggagtttttcaagacacaggaaaaagccctcattcccgacgacttggaaacgggcgaaacaatcaaaacaccgagggggactttctatgtaaccgccatgagccgagagcaaatggaagctgccggatatggattgcaccaccagtccgacgacggaaaatatttaattatggggaacggaacgcgggcgtttgccattttcgcagagcagccggaaaactatctgaaagctgctgagcagaccaccgagcaaaactacaacatgattgacgggcagataaacaacaccccgaccgttgcagaactggaagcaaaggtaaaggcaggagaaaccatttcccttgttgaccttgcggaagctgtcaaagctgataaggaacgcggaaaggcagcaaaaaaggaaaagaagccctctatccgggcgcagcttaaagcagataaagaaaagaccgcacagaaaaaagcgacaaaatcaaaaaatcacgaattggaggtatgagcatgattagactgaccgttgaagaaacgaacctgttgagcatttacaacgagggcggcaagcgcgggcttatggagaacatcaacgctgcgctgccgttcatggacgaggatatgcgggaactggcgaagcgcacccttgcaaaaatcgcacctctgacagaaaatgagtatgcggagcttgctattttcgccgctgatgaggtatgaccgggggtaagcggcttacgccgccccaaagccgaaaagtcaacagccttgtaaaaaaggagtgctgcaactgcgataacggacactgtattttac

SEQ ID NO: 517 - DNA, 1393 bp, Eubacterium hallii
ctcatgcaacagataaaaggaatacgtcctgagcctgccctgcgaatacgctccacctcctgcaagataagcatcaatctcatcctgcgtaatgaacatcggatgttctttccatgcaaacccgtcccttgcctgataagggatgatctcatccgcaaacttctgaaactgctttgagatatttacaggattataatgatggaaacgcataatggaatgattttcctcataggcttctgccagtgcatccagtctttcattcagttccgaaagccactggggatcttccaatttttcttccagataatctgtgatctccggatagatactgcgaagatgtggtaagtcctcttcgtcaaaaacaatctccgctactccttctgccatatcccctttcatataggcaagagcctgggcgtgttcttttactgcattacttcttgccgcatccaatacagactgtggtgcatattcaccctgatctaaaagctgatggatacgtccgctgacatcttcccatgataaaaatgccttatctaaaatctggtctgtgaccgtatgccccactgcgatctgcatcccggtttcatcaaaccagaccgaatattcatttccatcaatctgaaagccttttccacctttgcggtattcacgcttcacaaactccgtatattcctccggtgtctgttcactcatgaaattatagatgatccggagctggctggctttccggtttcctcctgtccgtaagatctcatcgacaacttcctctggaatcgggatttctccggcataaagggcagctgctctttcttctatctgccgcctttgttcatttgcggagggatattcgggcaaagataaagcagaggcgatctcttcctctgctttactcaatccatcttctcttgtatcttcgactaactgtataccaattccgtcaagatgctctcttccgctgttgccatcagtgcgttcatgtgtgctgtccatgccatcggatctgcttccttgtccggtgccggattcttctccagtaatttctccatctggctgtccattctctcctgtgctgctttctcgatctgttccagatggctgttcagcttcccggtcaggaacaggctctgataaaggctgttcttgtgttccttcagaaatgtcctccgcagcatcccgtatttcccgatcgtcacttcttcctcttcgacggtcagattcggaaacaggtaatctccctttcgatgatatgtcagttccataatcggttcctccttcattttcaatattttcttcttttttcgtttctgcatcgtggtttttagtttcacgcattaacgtggtaaagttattatagttcctttcattggaattttcaacctcttttctcgct

SEQ ID NO: 518 - DNA, 1305 bp, Eubacterium hallii
actccacctttctggtttactacggatataactttacacatgatttcttcctcctttaactttcccatgattcttttttccataattttagcagtgccagtatttcccgtttcatcattgccggtgtataagaatttggaaaatacttgtgtaactgctcattggtaaaagctactctggtgatctcaccttttttaacttcacacatgatttcttccatcttttctaacgataactgtttttctttactcagctgctttatccgctgagcctgtgagagtgacggaatcgcctgtgcataatccattgctttaagcagttctctttgttcattttctttcaatgcagcaatctctactgccggacaaaaagaaataatctcatcatccagtttctgcaacatttccggtataagctttgtcagtgatatataacgctgcacttgttttgggctatcaccacaatcctcactgataatatctatcgatcgttttcttggtgttttgtggtcaacttggctcttttttcgaccactttttctttttagtacgtcattcttcagtttgtaagcaaaagctttttcgctgtagctgatccgttctctgtgaagattagaatccaccatacttaaaatggaatcatcttcacttaatacccggataatcaccggtactttacgatatcccagtttctccgcagcatgttttcttctgtggccggatatgatctcatagtagccatccggtactggtctgacgatcagcggatttaaaatgccatacttctcaatgctttcctgcagaagaaacatttccttatcatcttttacttgaaatggatgttccttaaaagggcgaagacgctcaatctcaatttctatgattctttcttctttttctcctgattgtctgtttggctcagtcatcttgactcctttcctccaggattcagaaactaaaaaatgcctgcctggaacttttatagatagtaaagttccaaacagacattgctgtttgaccattagctgtagctaatagaattgaatactgtttcagctaatttatgtttgcaggtttgggagagattgtttcttttccctccttttctctgatttacatccccgaataaagggtgacaacggagcggaacccaaatgttagctggacttcctaaaacccaggtttgcaaaccggtaattttgattagctgtcagctaacaaaaatcggattgcgttagctggaaattgatcattttgaatggaattttgtgtcacgaacgtgatttgaaaataacaaaagcgttcg

SEQ ID NO: 519 - DNA, 1242 bp, Eubacterium hallii
cttttacagcttcttcacgcacacggtttctctcttccatttttttgtattccgcatcacgctctgcaaatatcttttccattttttcaaacaaagggtctgtgtttcggtttaataattcactcattttattatgtgccgaatttcggcacatcctccttccttaaaatttatctctatatttatctggtctggtatatctgcttctccccactcctaaaagcagcacaaagataaaaggcaaaaacatgattcctactgtataaccaaatccatgtccaaatgctctacttaaactataataaagcgttaccgtcaatccaaatgctatgcttggcagtgcaaactgtagcgtatctaaaaggacacctgcatttaatgttacagatactacttcgtacaaaaaaaggcagagccatttgaaaagacagatggaaggtttccatgctatcttaaataacagatattcattataaaatgggatcagcactttccagcctttttcgccagctttgcaaaaaactccccaatagcctatgactgttaatatcagtaaacatactgccatcaggaataaaatgatcaggattgcataatcttccatatctcctccatcaaatagggaaagcctgttggctctcccctatttactcttgtttaaaattttcttttaaatgtgccgaaattcggcacgttattttttacttaatagtaattacccatttatggacatcaccttttatccatcctcggagagtttttttcacagtacagctaatagtgaccgttccttttttcttcacagtcaccttatgaaaaccttcttcatctcctttcgtggatactgttgctattttagaattactgcttttccaatcctttgtttcaggatgcattgctgctacacttggaccaacccataatttttcttttttcttcatagtaatataattggttcttgtaaccggctttcttgtagtgcttttctttgccggtttctttttgctcttagcttctacagtaatactgcctgctggattttttaatgatgccgcagatggacttacaagcatcattgcaaacagtaaaaataatatcgccaaattcaaacggagtatcttttccataattcccctcctacaaaaagagagagccggcaggctctccctcattctttgtttacagatttagaatttttctaaagtcattggtttctttttcgcattccgtctctttttaata

SEQ ID NO: 520 - DNA, 1197 bp, Eubacterium hallii
agtagcgaagctgcggccccttcctgtcgagaaaagccgctatcgtgtagcaagggcccgtaccgtaaaccgacacaggtggatgaggagaggatcctaaggccggcgggagaagtgttgttaaggaactcggcaaaatgactccgtaacttcgggagaaggagtgctgcgcaagcagccgcagagaaatggcccaagcaactgtttagcaaaaacacaggtctatgcgaaaccggaaggtgaggtatatgggctgacgcctgcccggtgctggaaggttaaggggagagcttagcgcaagcgaaggtttgaacttaagccccagtaaacggcggccgtaactataacggtcctaaggtagcgaaattccttgtcgggtaagttccgacccgcacgaaaggcgtaatgatttgggcactgtctcaacaacacacccggtgaaattgaaataccagtgaagatgctggttacccgcgccaggacggaaagaccccatggagctttactccagcctgatactgggattcggtattgcatgtacaggataggtgggaggctaagaacttatggcgccagccgtaagggagccggtgttgggataccacccctgcagtactgggtttctaacctgcgcccgtgacccgggcgggggacaatgtcaggcggggagtttgactggggcggtcgcctccgaaagggtatcggaggcgctcaaaggtctcctcaggatggttggaaaccatccagagagtgcaaaggcagaaggaggcttgactgcgacaccgacgggtggagcaggtacgaaagtaggacttagtgatccggtggcataacgtgggattgccatcgctcaacggataaaagctaccctggggataacaggcttatcactcccaagagttcacatcgacggagtggtttggcacctcgatgtcggctcatcgcatcctggagctggagcaggttccaagggttgggctgttcgcccattaaagcggtacgcgagctgggttcagaacgtcgtgagacagttcggtccctatccggcgcgggcgcaggatatctgagaggagctgtccttagtacgagaggaccgggatggaccgtccgctggtggaccggttgtcatgccaatggcacggccgggtagccaagacgggaagggataaacgctgaaggcatctaagcgtgaagccc

SEQ ID NO: 521 - DNA, 1192 bp, Eubacterium hallii
atctggatataccacgagatcgaaagggagattttgaaccgcagattgtgaaaaagaatcagacagatatctcaaacattgaagatcaggtactttctatgtatgcgaagggaatgacgacaagggatatctcctctcatctcaaagatgtttatggtgtggatgcatcagcagaaatgatatcacatatgacagatcgaatccttcctatcgcaaaagaatggcaaaatcggccgctggaaagaaaatatgccattgtttttatggatgcggtacatttccatgttcgagaagacaatcgaacggtaaaaaaagcggtttacgttgctataggtgttaaactgaatggaaaacgtgaggttctcggcatgtgggtaggaggaaatgaaagtgcaaaatactggttgtccgttctcaacgagataaaaaacagaggtgtggaagatatcatgatcgtatccgtagatggattgaccggattcggggatgccattcatgcagtattcccacaggcggagatccaaaggtgtattgtgcatcagattcgttattctacaaaatttatctcttacaaagatttaaaaccatttatagcggatttaaagctggtttacaaagctgatacagaagatcttgcactcacagccttggaagatctggaagaaaaatggggcaaaaaataccctgcttccattggatcctggagaaataactggacacaattatccacatattttaaatatccatctgagatacgtaaattaatatacactacaaattccatcgaaaattttaaccgccagctacgcaaggttacgaaatccaagactatttttccgacggatgatgcacttttcaagatgctctatctggcaatgatggatgctacaaaaaaatggaccggaaaggcttgggactggggtctgacactggatcagttatgcatttattttggggatcggatccagccagaggatatcgattaagcacagattcaatcgcatatcaagggtaaataaacacccgattttctcgggcacccttgacatgcaatagaatccatgctactaaataaacaacaggctgaatagcaaagtatgccattcagcccattacattatatttttgtattctataaacctatgattttatcatcaatctgagaggtttacacagaataatttacactacc

SEQ ID NO: 522 - DNA, 1064 bp, Eubacterium hallii
gggcagaacttatgcataattatctgtattttagaacaggaagtattggatttgaagattttgcggaagattctggacaggttttaaaagaattgtatcgttctactgaagagaatgaatggaagctttaccgaatgcatttcctgttaatggaagaacagcaggaagaggcgaaggcggcgatggaagctttagaagagattgcacaaaaaggcggttttaaaccgttagaagcgaattattttctttatcttaaagcaatgtattaccggactccggaggtgatcagcaaggcggtcaccggaataagagaattttacgaattatcagaatataaggcagaggcgctgtggatgctcatttatcttgatagagagtatgtgtataataagcggcttcagtatgatacaatacgacaattatttgaagatggaaataatagcagcttattatactttgaagcttgtgatattttaaatgagaatccaaattatatggaagagcttggcaagtttgaaatcagtattttccgatggggagtaagatacggctatatttcactggcactttcctatcagtttgcccggcttgctttaaagatgaagttttataataaggcagtattttatattgcacagaagctatatggtgttgaaccggatgaacagtttttacaggtaatctgttcccttcttataaaagggaatcgaacagggaaggaataccatgaatacttccgtcttgcagtggaggcaaatcttaagatcataggattgaatgaattctttatccgcagtatggactttacaacatatgatattattccgcagagagtgcttatttattttacttatagtaacagccttgattatctggaaaaggcatatctttatagtaatgtactgcgtaataaagaaagttatgaagaagtatacggtgcatattattccaaaatgcttccatttgtggaagaacagctgttaaaaggaagaattaatgaacatctggcatatctgtatacttgttttcaaaaagaagttcttgaaaagccggataactggaag

SEQ ID NO: 523 - DNA, 1001 bp, Eubacterium hallii
agtcagtacgtgcaggcccgaaaccgggtgacctatccatgtccaggttgaagccgccgtaaaaggcgatggaggaccgaacccacatccgttgaaaagggtggggatgaggtgtggatagcggagaaattccaatcgaacccggagatagctggttctcctcgaaatagctttagggctagcctcatacaagtctgccggaggtagagcactgaatttccgcgggggcgtcaaagcctaccaaagaatatcaaactccgaatgccggacagatggtgtatgggagtcagactgtacgagataagttggacagtcaaaagggaaagagcccagaccgccggctaaggtcccaaagtgggtgttaagtggaaaaggatgtgggatctctaagacaaccaggatgttggctcagaagcagccattcattaaaagagtgcgtaacagctcactggtcgagaggtcctgcgccgaaaatgtccggggctgaaacaccacaccgaagccgcggaactcgtaagagttggtagaggagcattcttaggggagggaagcattaccggaaggggatgtggactgctaagaagagagaatgccggaatgagtagcgagagcaaggtgggaatccttgcggccgaatatccaaggtttccagagtaaagctgatctgctctgggtaagtcggggcctaaggagaggcagagatgcgtatccgatggacagcaggtaaaagattcctgcaccccttgttatcagaactgcggggacacgggaagggaagcagagccgggaatggaaagcccggtgcaagcggagtagtcgcaggattggaaaatccgtcctgcataagacgaaggcgtgatgcggagcgaaacgaagtagcgaagctgcggccccttcctgtcgagaaaagccgctatcgtgtagcaagggcccgtaccgtaaaccgacacaggtggatgaggagaggatcctaaggccggcgggagaagtgttgttaagga
